United States Patent 8,692,064 (QUANTITATIVE TRAIT LOCI ASSOCIATED WITH SOYBEAN CYST NEMATODE RESISTANCE AND METHODS OF THEIR USE) - sequence listing, part 2

SEQ ID NO: 2826 - DNA, 744 bp, Glycine Max
atgatgacatgctccgtggatttgaacaacaaagatttggacataagcttctatgttttcaagccaactgtagtaattgttgatcatctagttcatggactccaacagttttccttactcactcagaatcttggttgtgtacaaagctctatatttaggagcatacatggaaatacgatcatatggtatggagcatggcagaaacggtctagtgatgaaaaagataagctgacagcaaatcttcaatcaatgctaaccaataatgtaacaagaatggcagtcttggttgaacacaatttccttgatgcatatgctggagaatcaagagatggctctttggctgtaaagttcagcactggtgacataatctccatgaactcagtagtcacaactacaaaggaccttaatgacctgtgctatgcagtcctagcaatttttaggtctcgttttcccaaaacagaaggcataacttcaggcctttgtatgaaaggccaatgcttaccaagagtggtatgcattcatgtgtggcagtccctacaattttgttactcatggattctcaactcagaccatagaaagtggatgatgccttatcttgaacgcttctccactgagatgaagcatgatatttttcgagtagtttatgttagtgatgaaaatgtgatgaatgttccctacgattctcctcatcggatgttagaagatgaagaagagagcacacaaggacaacttatgcaccactga

SEQ ID NO: 2827 - DNA, 756 bp, Glycine Max
atgatgactccaaacttgaacttggaaatcgaaaatcattcagaaggcagcagccaagtggcttcaaatgtatccttgcatgaagcatctcatgatcttacaaagggcagcaccaccacttcctcctgtctcacaaaggatgaaactgatccaggtttcattacccttgacttgacactcaacttcaataattccggtgatggcgagttgaaagtctcgagtgatgctagcagtgaagttggagctgaagctcctgcttcagcatcagcaactccaagggttttctcttgtaactactgcaggaggaagttctatagctctcaggcattagggggtcatcaaaatgcacacaaaagggagaggacgatggctaagcgcgcaatgcgaatggggatgttcactgagaggtttacaagcttggcatctctacctcttcatggttcacctttcaggtctcttggccttgaagctcattctgcaatgcaccgaagacacgtgccatcctccgtgacagcactgagggctcctgatatgagagctgctgcaaaatttgagagaaaccaatttggatcactggttttcatggaagatgatgatgttggattcttttggcctggcagtttcagacaggtagaccaacaaggagctggtgatgttaatgtaggacatgctcaaagttcaaatgctagtttagctccaatggtgcctcctccaccacaagcttctgcatctcctgatctcacattgaagctttaa

SEQ ID NO: 2828 - DNA, 903 bp, Glycine Max; identical to SEQ ID NO: 240

SEQ ID NO: 2829 - DNA, 987 bp, Glycine Max
atgatgccaggcaatggacagttaacagttcctccgggcttcaggttccaccctactgatgaggagcttctctactattacctgaggaagaaagtttcttatgaagccattgatcttgatgtcataagagaagtagatctcaacaaacttgagccttgggacctcaatgataagtgtaggattgggtcagggcctcagaatgagtggtatttcttcagccacaaggacaagaagtacccaacaggaaccagaacaaaccgagcaactacagctgggttttggaaagcaactgggagggacaaggccatataccacactaattccaagaggattggcatgaggaaaaccctagttttctacactggtcgtgctcctcatggccaaaagactgattggatcatgcatgagtatcgccttgatgaagatgatgctgatattcaagaagatgggtgggtggtatgcagggtgttcaaaaagaaaagccaaaaccgaggtttccagcaagaaattgaagaagaagagcacttaaccacccatatgagagcaagtggtcattgccaggtcctagagccaaagcatcatcacatgcaacaaggactctatgatcactacaacttcgatgggacaatgcatctcccacagttgttcagtcaagaatcagcagttgcaccacccacaaattcttccttggcctcatctatgaatgccatggacatccttcagtgctctcaaaacctcctgaggctcacaaccactactggctgtggacttaatctcatgcagcagcaacaacaacaaggagagaggttcagtggtgactggtctttcttggacaagctactagcatcacaccatggcatggatcaaagcaaatgtaaccctcctactcatcatcaaggtgcaagtgtgggaacttcagctcagaaattcccatttcattaccttggctgtgacaccacccatgatatcatgaaattttccaagtag

SEQ ID NO: 2830 - DNA, 453 bp, Glycine Max
atgatggagatgaatatattggcttcttcgttctctggttatgcaaaaccctttgtaagagtaaacccttctcttcttacgctcagggcatcttctctgcgccatgactaccctcttgcaagcaaaattgttgtcaaaaatttaccatattctaccggtgagactactttgcagaaggaattttcaaattttggcaagatagctgaagttaaaatggttaaagatatgaacacaaaaagatctaagggtattgctttcattcaatatacatgtcaagatgatgccatgcttgcactagaaaccatggatcagaaggatttttatggtcgaacaatcggcgtggaaattgcaagactgggttgggatgattttggtgcatccccaagggcctcaggacccccaaagaagtgggatttgccagagcaaggggaagtggtagattgctggtactga

SEQ ID NO: 2831 - DNA, 201 bp, Glycine Max
atgatggagtgctgcaagattgctatagttctcaccatctacattatggctatgttggtttttgctcactgttgtgtggctgagaatgtagctgaagatgttgctgcaattccacccacaccaatggaaagtgcaggggtgcatctttgtgcctcagctgtttttgtagtcactgcttttgtggttgctatgttcacctaa

SEQ ID NO: 2832 - DNA, 2301 bp, Glycine Max
atgatggatgttgctgaggttgaggaaaatctgtttgccgcaagtgatgccaagttacatggacagatgtgcaagactctttctataatctattgcaaagtactgtctgtatttccttctttagaagctgctaggcctaggagtaaatctggtattcaggcattatgttcattgcatgtagccttggagaaagtcaagaatgttcttcagcactgctcagagtgtagtaaactttacttggctataactggagattctgtcctcctaaaatttgagaaggctaaatgtgctcttgaagatagtcttagacgggtggaagatattgttccacaatctattgggtgtcaggttcaggagattgtgaatgaatttgcaacaatagaatttgcacttgatccatcagagaagcaagttggtgatgatttaattgcattgctccaacagggaagaaagttgaatgactctaatgacagcaatgagcttgaatcttttcaccaggctgctactagacttggaattgcatcttcaagagcagctcttgccgaaagaagagctctcaagaaactcatagtgagggctcgatctgaggaagacaagcggaaggaatcaattattgcatatcttttacatcttatgaggaaatactccaagttatttagaaacgagttctcagatgacaatgattctcagggttctgcaccttgttctcccagtgttcagggatccattgaggatagtgttcctggtagtcattgtcaagcctttgacagacagctttcaaaactcagttgctttaatttcaaaccaaataatagtaggaaatcagggcagatgcctcttccgcctgaagagttaaggtgtccaatatctctgcaacttatgtatgatcctgttaccattgcttctgggcaaacttatgaaagggtttggatagagaaatggtttagtgatgggcacaacaactgcccaaagacccagcagaaactttcacatctttgtttgactcctaattattgtgttaagggccttgttgctagttggtgtgaacaaaatggagttcctattcctgaaggccctcctgaatctcttgatcttaactactggggaatggtattatcagagtctgaatctacaaattcaaaatctatagatagtgttagctattgcaagttgaagggtgtccttgtggttcctttggaagagagcggtatctcagaggaatatgtggaaaatggaactgaaagtgtttctgcacaagaggaagactctgagcagtattttagctttctgaaagtcttgactgaggggaacaattggaggaagcaatgtgaagtggtagaacagttaaggctgttgctgagggatgatgaggaagccaggatttttatgggggctaatgggtttgttgaagcacttttgcagtttttgcaatcagctttgcgtgaaggtagtttgatggctctggaaagtggagcaatggctctcttcaacctggctgtgaataataacagaaataaggaaattatgttatcagctggagtattatcattgttggaggaaatgatttctaaaactagttcttatggttgtacaactgctctttatttgaatctctcttgccttgaagaagccaagcctatgattggcgtgactcaggctgtccagttcctaatccagcttcttcaatctgactctgatgttcaatgcaagcaagattctctccatgctctctataatctttctactgtgccctccaatattccatgcctcctttcatttggcatcattagtggcttacaatcccttcttgtaggcgagggggatagcatttggacagaaaaatgtgtagctgttttgataaatttagcaacttctcaagttggaagggaggaaatcgtatcaactcctggactcatcggtgcattggcttcaatattggacaccggggagctcatagaacaggagcaagctgtctcttgtctcctaattttgtgcaatagaagtgaggaatgtagtgagatggtcctgcaggaaggggttataccagcattggtttcaatatcagtgaatggaactccaagaggtcaagaaaaagctcagaaactcttaatgttgttccgagagcagcgacgggacccttcaccagttaagacacataagtgcccacctgaaactgctagtgatttgtctatgccacctgctgaaatgaaaccgatatgcaagtcgattttgagaagaaagtccgggagagcttttagctttttctggaaaaacaagagctattctgtataccagtgttaa

SEQ ID NO: 2833 - DNA, 1668 bp, Glycine Max; identical to SEQ ID NO: 241

SEQ ID NO: 2834 - DNA, 1062 bp, Glycine Max
atgatgggaaccgcatgtttcccaactaataacgttgttctcaaacctcaaaacttatctgggaatttctctaccctctgtgataacgttcggtgtctgaggttcctcactcccaaaccgccccacctgcgatcctctcactctaacttgggaaatagagcacagttgacatctttttcgatgtccaaggcaacccaattgaaggtttcgcaagatgcactctcatccacggaacaatcactgtcttcatctcctcgggtaataggagaacatgacttgctcattgtgggtcccggggttcttggtcgtttggttgctcagaaatggcgtcaggaaattccgggtagtcaagtttatggtcagacagtgagcactgatcatcacaatgagttgattcaaatgggtattaacccgtctaagaaatggacagaggctactcacacatttcccaatgtcatttattgtgctccaccttctcgtaccccagactatgctggcaatgtcaggctagctgcattaagctggaatggtgaaggttctttcttatttacatcaagcagtgctccatatgattgtaatgataatggaccatgtgatgaggattctccggttgtgcctatcgggaggagccccggagttgatgtccttctaaaagccgaaaatgtggtactggagtttggtggctgtgttctaagattggcaggactatataaagcagatagaggtgcacacaattactacttggaaaagcgtattgttgatagtcgtcctgatcacgtcctgaatcttatacattatgaggatgcagcttccctctcagttgcaatcttgaagaaaaaattccgtgggcagattttcttgggttgtgataatcatcctttgtctaggcaagaaatgatggatctggttaataaaagtgggaaattcagtaaaaaatttgacgagtttactggaactgatggccctctaggaaagagattaaacaacacaaaaacctgccaggtagttgggtggaagcccaagtaccctagctttattcattttctagagagcagcatgtga

SEQ ID NO: 2835 - DNA, 768 bp, Glycine Max
atgatgggaaccgcatgtttcccaactaataacgttgttctcaaacctcaaaacttatctgggaatttctctaccctctgtgataacgttcggtgtctgaggttcctcactcccaaaccgccccacctgcgatcctctcactctaacttgggaaatagagcacagttgacatctttttcgatgtccaaggcaacccaattgaaggtttcgcaagatgcactctcatccacggaacaatcactgtcttcatctcctcgggtaataggagaacatgacttgctcattgtgggtcccggggttcttggtcgtttggttgctcagaaatggcgtcaggaaattccgggtagtcaagtttatggtcagacagtgagcactgatcatcacaatgagttgattcaaatgggtattaacccgtctaagaaatggacagaggctactcacacatttcccaatgtcatttattgtgctccaccttctcgtaccccagactatgctggcaatgtcaggctagctgcattaagctggaatggtgaaggttctttcttatttacatcaagcagtgctccatatgattgtaatgataatggaccatgtgatgaggattctccggttgtgcctatcgggaggagccccggagttgatgtccttctaaaagccgaaaatgtggtactggagtttggtggctgtgttctaagattggcaggactatatatatccttggttggatgcaaattattaggatcacaaaatattgttttttacttgtga

SEQ ID NO: 2836 - DNA, 681 bp, Glycine Max; identical to SEQ ID NO: 242

SEQ ID NO: 2837 - DNA, 2145 bp, Glycine Max
atgatggttgtaggtgtaccaacattgcccccaaattttgaggaggaaacatgggcaaaattgaagtcagctattggtgctatatttatgaagcaacctgtttcctgtgacttggagaatctttatcaggctgtgaatgatctttgcctttacaaaatggggggaaatctttatcaacgaattacaaaggagtgtgaagagcatatatctgtggcactgcagtctttagttggccaaagcccagatttgattgtttttctatccctagttgagaggtgttggcaggatctttgtgaccaactgttgatgattcgtggtatagccttgtttctggataggacctatgtgaaacaaacaacaaatgtacggtcattatgggacatgggtttgcaacttttcagcaaacatctttctctatcttcagaagtagaacataaaactgttactggtcttctccgtatgatcgaaagtgaaagatcaggcgaatcagtggatagaactcttctaaatcatcttttgaagatgtttactgctctgggaatttatgtagaaacctttgagaagccattccttgagtgcacatccgaattttatgcggcggaagttatgaaatacatgcagcaatcagatgctccagattacttgaagcatgttgagacaagattgcaagaggaacatgaaagatgtttgttgtacttggatgcaagtactaggaaaccattgatagggattgcagaaaagcagcttcttgaacgtcatatacctgccattcttgataagggttttattatgcttatggatgggaatcgtattgaagaccttcagagaatgcactcactcttttcaagggtcaatgcccttgaatcactgaagcaggcccttagttcatacattaggagaactgggcagggcattgttatggatgaggagaaagataaagatatggtctcatcccttcttgaatttaaggcttctcttgacacaatatgggaagaaagctttttcaagaatgaacctttcagcaattcaattaaagatgcatttgaatatcttatcaatcttcgtcagaaccgacctgcagagttgattgccaagtttttggatgagaaacttcgtgcaggtaataagggtacttctgaagaggaactagaggctacacttgataaagtcctggtgttattcaggttcattcagggcaaggatgtatttgaagcattctataagaaagatcttgctaaaagactgcttttaggaaagagtgcttctattgacggtgagaaatctatgatctccaagttgaagactgagtgtggcagccagttcacaaacaaactggaaggaatgtttaaggacattgaattatcaaaagaaataaatgagtcattcaaacagtcatcacaggcgaggtcaaaacttgcatcagggattgaaatgagtgttcatgttttaaccacagggtattggccaacatatccccccattgatgttagacttcctcatgaattgaatgtttaccaggatattttcaaagagttctatctaagcaaatacagtggaagacatctgatgtggcaaaattcactaggtcactgtgtcttgaaggcagagtttcccaaaggaagaaaggagttggctgtgtccctttttcagactgttgttctaatgttattcaatgatgctgagaagttaagtcttcaagatatcaaagatgctactggtattgaggacaaggaactgagacggattctgcaatcactagcttgtggtaaagttcgtgtcctacaaaagatgcccaaaggaagagatgtggaggacgatgactcatttgtttttaatgatgggtttacagctcctctttaccgtataaaggtgaatgcaattcaattgaaggagacagtcgaggagaacacaagcaccaccgaaagagttttccaagaccgtcagtatcagattgatgctgctcttgtgaggataatgaagactagaaaagtgcttagtcacacccttcttattactgaactcttccaacagctgaaattcccaataaaaccagctgatttgaaaaaaaggattgaaagcctcattgacagggagtatctagagagggacaagagcaatcctcaaatatacaattacctcgcatag

SEQ ID NO: 2838 - DNA, 2055 bp, Glycine Max
atgatgtccaaccgcgcatggaccacgcgcctccaaaactcgatccgctccctcgtcccggaattcgacccctccctcgtctacaacgtcctccacggcgccgcctcgccggaacacgcgcttcagttctaccgctgggtcgagcgcgccggcctcttcacccacaccccggaaaccaccctcaagatcgtccaaatcctcggccgatactccaagctcaaccacgctcgctgcatcctcttcgacgacactcgcggcggcgcgtcacgcgccaccgtcaccgaggacgccttcgtctccctcatcgacagctacggccgcgccgggatcgtgcaggagtccgtcaagcttttcaagaaaatgaaggagctcggcgtggaccgcaccgtgaaatcctacgacgcgcttttcaaggtcattctccgacgcggacgctacatgatggcgaagaggtactataatgccatgttgaatgagagcgtggagcccacgcgccacacttataacattctgctttggggtatgtttctgtcgttgagattggacactgctgttaggttttacgaggatatgaagagtaggggcattttgcctgatgttgtgacttataacactttgattaatggttattttcggtttaagaaggtggaggaggctgaaaagttgtttgtggagatgaaggggagggatattgttcccaatgtgattagtttcaccaccatgttgaaggggtatgttgcggcggggcagattgatgatgctttgaaggtttttgaggagatgaagggctgtggagttaagccgaatgcggtgactttctccacactgttgccggggctgtgtgacgccgagaagatggcggaggcgagggatgtgttaggggagatggtggagaggtacattgcaccgaaggataatgctgtgtttatgaagttgatgagttgccagtgtaaggctggggacttggatgcggctggggatgtgctgaaggcgatgattaggctgagcattccgaccgaggctgggcactatggggtgctgattgagaatttttgcaaggcaaatttgtatgacaaggcggagaagttgttggacaagatgattgagaaggagattgtgttgcggcagaagaatgcttatgagacagagctttttgagatggagcctagtgcttataatttgatgattgggtatttgtgtgagcatgggcggactggtaaggcagagacttttttccgccagttgatgaaaaagggtgtgcaggattcggtttcttttaataatttgatatgtgggcactcgaaggaaggcaaccctgattctgcctttgagattataaagatcatggggaggagaggggttgctagagatgcggattcctacaggttgcttattgagagttacttgagaaaaggggagccggctgatgctaaaacagctttggacggcatgcttgagagtgggcatctaccggaatcatcgctttataggtcagttatggagagtttgtttgatgatggcagggttcaaactgctagcagagtaatgaagagtatggtggagaagggggtgaaggagaatatggacttggtttcgaaggtattggaggcccttctcatgaggggtcatgtggaagaagctctgggacgaattcatttgcttatgcttaatgggtgtgagcctgattttgaccatcttttatctgttctttgtgagaaagaaaagacaattgctgctctcaaactgttagattttgttcttgaaagagactgtatcatagatttttcaatctatgataaggttttagatgctctcttagcagcagggaagacactcaatgcttattccattttatgtaaaattctggagaaaggaggatcaacagattggagcagccgtgatgagctgatcaagagtcttaatcaggaggggaacacaaagcaagcagatgttttgtcaagaatgatcaagggaacagatggaggaagagaattcatgaattgttctttatttcaaatccaaatttgcaactcctgtgctgagtcttctgactga

SEQ ID NO: 2839 - DNA, 1089 bp, Glycine Max
atgatgtctttgcagaggaccaagttgtttccttttttcattgtccttgtttccttcacatgtagtctctcccttgctatgtccagtaaccagttggagcagtttgcttcggaggaagaagtgtttcaactattccaagcgtggcagaaggagcataagcgtgaatatggcaaccaagaggagaaggcaaagaggttccagatattccaaagtaatttgaggtacatcaacgagatgaatgcgaagaggaagtcacctacgacgcaacatcgtttgggtctgaacaagtttgctgatatgagtcctgaggagtttatgaaaacctacttgaaagaaatagagatgccctactccaacttggagagtaggaagaagctgcagaagggtgatgatgctgactgtgataatcttcctcattctgtagattggagggacaagggagctgtcactgaagttagagaccaaggaaaatgccaaagccattgggctttcagtgtcacgggggccatagaaggaataaacaaaatagttactgggaatcttgtttccctatctgtacaacaagtcgtggattgtgaccctgctagccatggttgtgctggaggcttttacttcaatgcgtttggttacgttatagaaaatggtggcattgacacagaagctcattatccttacacagcccaaaacggtacttgcaaggcgaatgcaaacaaggttgttagtattgataatcttctagttgtggttggaccagaagaagctctcttgtgccgtgttagcaaacaacctgttagcgtgagcatagatgcaactggccttcaattttatgcgggtggagtctatggtggtgagaactgctcaaagaattcaacaaaagcgactcttgtttgtttaatcgtgggttatggttcggtgggtggcgaagactattggattgtgaagaactcgtggggaaaagactggggagaagaaggttacctcttaatcaaaaggaatgttagcgacgagtggccttatggtgtttgtgccatcaatgctgcacctggttttccaataatcaaagaggttgcatcgtcttcagctatatag

SEQ ID NO: 2840 - DNA, 519 bp, Glycine Max
atgatgtgcttattcatacaggtacctgaaacactttctgaagaggtccttgggaagatgggtgcacctccaaagagtgatgtaccgattattacacccaacgagctacctgaggctgatggcttattgcttggtttccccacaagatttggactgatggctgctcaattcaaagctttcatggatgcaactggaggcctgtggcgcacacaggcactagctggaaagcctgcaggaatcttttacagcactggttctcaaggaggtggacaagagactactccgttgacatctattactcagcttgttcaccatgggatgatttttgtgcccattggttacacatttggtgctgggatgtttgagatggagaatgtgaagggtggatccccttatggtgcaggtacctatgccggggatggttccagacaaccaactgagttagaattggctcaagcttttcatcaagggaagtactttgctggcattgctaagaagcttaagggatcatctcagtga

SEQ ID NO: 2841 - DNA, 588 bp, Glycine Max
atgattaaaaaaatcagagcaatgaatgttttatatttaagctcaagttcaagcctaagcatgtccaagccgtttcaattctcaagtaaacatcatcaaagagcttctagtgtgaagtttggtggtgtttcatgcagagccgcaacgttaacccaagaaaacttgtacaaaatattgtctgtgtgtccaggaagtgcaacaatggatgagatcaagagggcttataggtcaatggctcttcagtaccaccctgatgtgtgccatgatccttccatgaaagaggaatcaacgaggatgtttgttcagctaaacacagcttacaagaccttgtccaatccaaggcttcgagaagagtatgacagtgaattgggtttgggaagcacagagatgagtactgttagtagtgatcatcatgagagatggggaagtgtgagtgttagtagtgaacatgagagatgggaaagtaggtttcaggagcaaatgattgagttgaagacaaggtctcgtagacgtatgggacaaaagggtcagggtggatcatcgggtagtagcagaatgaggacacaaaacatgagagacaggaattga

SEQ ID NO: 2842 - DNA, 702 bp, Glycine Max
atgattaatgttgttttgtttgtgcagagggatatggagaacaagaagagtgaggaagaactgaagcatctcgggtttgtgaagattgcggcaatgaaagccttagtgtgtgtgtcgaatctctacggcttcgcaaagcaaaactcgggacttttgagatctgctgttggaaccgtggaagacactgtaaccaccgttctgggtcccgtctaccacaaattcaacgctgttcccaaccacatcctcctttttgtcgacaacaaggtggatgaagctgctcacaaattcgatgagcatgcaccttctttggccaagcaggttgcaagccaagtcacttgtttggttcaggaagtgacacacaaagctgagaaagtagtgagtgaagctcaatctggaggggcacgagcagcagcaaattatgtagccactgagtccaagcaaattgtgctctttggttcagtgaaattgtggactggtctcaaccactatccaccattccatgcagtggctgagatggcagttcccacagctgcacactggtcagaaaaatacaacaatgtggtcaagggaacaagtgagaagggttatgccgtgtttgactatttgcctctgattccaattgatgacattgctaaggcgtttaaacacggagaaggcaatgtgaatgaagatgaagcatgttccgtgggagactgttcttag

SEQ ID NO: 2843 - DNA, 2220 bp, Glycine Max
atgattccctctccggcttctcctcataccccatttttccctcagtgcttaaattggttgttgtataatcaactcttagatggttcctggggtcttccagatcgccatccattattgatgaatgatgctctcttgtctaccttagcaagcatccttgcattaaagcaatggggtgttggtgaagatcaaattaataggggtcttcgttttattcaatcaaacattacttcaatcaatgatgagaatcaacaccctcccataggatttggtatactttttccttctatgattgaatatgcacaaaatttgggcattaacctcccaattggagctacaagcttggaagcaatgatccagaagagagaaatagagctccacagaggtagtcaaagcaattcagatgggaggagagcatatctagcatatgtttcagaaggaatgctggaatcacaagactggaaatcaatcatgaaatatcaaagaaagaatggatcgttgtttaactcacctgctacaacggcagctgtttttcagtgccataagaatgctgaatgtcttggttacctccaatccgtattagaaaagtttgaaaatgcagttccgacaacttatcctctggatatatatgcccgtctctgtatgattgatagtcttgaaaggttgggtattaatcatcatttcaaagaggaaattcgaagtgtattggatgaaatattcagatattggatgcaaggagtggaagatatattcttagaccccaccacctgtgcaatggcatttcgtatgttgcgtctcaatggctatgatgtatcttcagatccattttatcaatattctgaagataaatttgctgaatccttgaaagggtacttgaaggatgttggtgctgttatagagctatatagggcttcacaagccattatacatcccgatgaatcaattttggtgagacaaagtttgtggacaaaacatcttctgaagcaggaatcctccccttacagattatatgctgataaacttcgtagttatgttgacctagagatcaaggatgttcttaattttccttatcatgcaaatttggagcgattgttaaacaggagatcaatggagcattacaacacagtagaaacaagaattttaaaagcatcatatagatcttgcaatcttgcaaaccaagaaattctaaagctagcagtagaagacttcaatatctgccaagcgatacacattgaagagttgaaacagctttcaaggtgggttgttgagagaagactagacacactaaaatttgcaaggcagaaactggcttattgttacttctcctgtgcagctactattttctcccctgaactttctgatgctcgcatatcatgggcgaaaagtggggtgctcacaacagttgttgatgatttctttgatgttgggggttctgaagaggaacatgtgaatcttattcaactagttgagaagtgggatgtagatatcaatactgtttgttgttctgagacagttaagataatattttccgcaattcacagcacagtttgtgagattggagagaaatcagtcaagcagcaaggacgcaatgtgaaaaacaatgttatcaaaatttggttgaatttggtccagtcaatgtttagagaagctgagtggttgagaaccaagactgtgccaacaattggtgactatatggaaaatgcatacatatcatttgccttaggaccaattgtccttccggccctctatctggttggacctaagctttcagatgaagtcacagaaaatcatgagttgaactatctctataagctcatgagcacatgtggccgtcttcttaatgacattcacagttttaagagagaatccgaggaagggaaattgaatgtgctggctttgcgtattgctcatggcaatggagttattactgcagaagatgccaccgaagaaatgaagggtattgctgaagaaaagagaagagaactcctgagattaattttgcaggaaaaaggaagtgtagttcccagagagtgcaaggatttgttttggaaaatgataaaagtgttgcacctgttttacatgaaggatgatggatttacttcacacgagatgcactctagtgtaaatgcagtacttaaaaaacctgtcatccttaatgaattgttagtacattctcagcagaaccttagtcctgtcaaagccactaatgacctgatgctctag

SEQ ID NO: 2844 - DNA, 1323 bp, Glycine Max
atgattcctccgaggcggaagaaatggaccgaggcggaggagaaaaccctaatcgacaagtacggggagctggtggaggacggttcgctggctaagatgcggacgcgggagaagaagttcaagccgattgcttgtcacgtgaattcggtgcatcacgttcgcgatcccgtggcgtacccttggcagtggagttggaaggacgtttcgacgaaggtgcagaacatgcggcaccagtatttgcttgtgaagcagaagatcaagaggcccgagttttctgggtccggaggaggaggggattgtgatgatgtgagtgagtttgactgggtggaggggcttactcattggtctaattttcttaggtataaggatgtgtttggggatgttgcacttgttgttggtggtcatggtgggaatgagttgatggggattgaggatggggatcacggggatcgtgatggggataatggggatggttttcttgctggtggtggggggatggatatggttgagtttgggcagatgggtcattccggggatggggatttcggggctgctatggatggggtggacaatgaggtgatggggttggggtttgagtatgaggctgaggaaggggaggtgaattacaatgggagtggtggtcgggagagggaggatgcagccgagaatggttttgtgtttgaggaggaaggggaagtcacagggtcaagtttgaagaagaagaggaaggcagtgaaggggatggagaagaaggcgtggaggattcttgctaaccagctggggcagttgagggagatggaggcgcggttcgagcagcgtgagctggagagggagcgtgataggcagaggagggagaatttgcgagtggagcttgataagcagtgggagaagaagcttgaggagagggacaaacttaggaggcagaggatggtggagtgggaagctatggagaaggaaaatgaagagatggaaaggaagaggagagaggaagagttgattcatgagagggaatgggaggagggaatgaattgcaggaggctggaatggaagaagagggttgacgagatgctgagccagcaccgagcagaaatgggccagatgcagactcgttttcttcatgagcagcaaaatcttactaaccaattgcttggtatattctcgcagtggcctgcccaacccgctggcctatctgatcacactagtgctagcaaccattatctttcacatatgatgcaaaatttgcatcatgtgaatggaattgttcacggtgacgctagggttgagggagataatcaagaagatcaattcattgttgatggatga

SEQ ID NO: 2845 - DNA, 865 bp, Glycine Max
atgattcgtccagtcactcttcgcgacgtagccgagggagtttcccggcggaggtgccaggtgtcgggtgacgagaaggaagggggaggccccgaaggcgtcatcgtgctccacgacggcggaagatatgatttggttatccccagcacccatgtcgcctccaccgccgctagctctgccgtttccaacgccacactcctcggctacgccattggaacggcccacgggatggctttgctggaccggcgactgcttcgcctcccgctctcccttggtggctcctcctcctcctctgtcccttactactttgacaacatccccattggagccttcgcgacgctagagagaggcatctttgtcgcgtgctcgacggggaataccgaaccttgcaacggttctgtcacaaatgtcgctccgtggatcatgactatcgacgccagcacgctagacagtgatttttcgacatacgctactctcagaaacggaaaacacttcgctggaatttcactgtacagtggagaggggatgggagacgaaccggtcaatttggtttatttcagcgaccgatcgaactcgtcaggcaacatttgcatgtctggttcgctcaacccgaagagcggaactcaactcacgcatggagaagggtgtagtggtgcgcgacgccggcgggtagggatgatactcgcaaacacgacggtgagcggcgagggactggtggcggacagtcacttggtggccgccgttgcggtgggggaatccgcgggggatgagatcagagattacccgtctttggatcctaatccaatcgcgaatcgtttgatgtgtctctctgttgacacatgtcagtcaacatcacttgctaata

SEQ ID NO: 2846 - DNA, 2385 bp, Glycine Max
atgattggaagtaaagatcgttctgctgactttgaaggtgagaactccaggagcaagctttcaaggcacaattttgaggccaacaaggagtacccagatgaaaaaggtgttgaatttctgagggattcatcagaagtgggtggttgtggtggcagctcagggttgcaagagttgaccctcagctacctttgtgacaacccaaaattcaatcttgctgagaaagagattcctggtaaaagcttgttggagaaaatgagccacaaaggtaaagaggttgtggtatgtgagaattcatatcaagatgggaaatgggtggaaagagatttcctcagcctgagtgagccaagagaagattcttcaaagagatcccttgaggaagttgttgagagagagagtaatagggagaagaagccaaaattagagattctcaacctctctcttgctttgcctgatgtgtcactttccctcacagcctcaaacgccttgcaaaacggtggtgatcatcaacaacaagttaggactaatccttgcaggccatcatccactactcacacttcatattccaatgactacactgcagcttctttgtcttactcttattcccaccctttctctcacaacccaagttgttcactcacccacaattcaactgatatgtttgattactcagtgagcaaagatgaccaaatttggaactgtggagagggaactaatggctcagtgcatagtaggttcaagccaattagagatggcttggttggtttatccaaccatggtggtggtggtggtattagttcctttatgcaaggtaataataatagtcagtataaaactactactagttcagataaccattcttttttcccttcagagttgccagcaaggccaaggtttgaggctcagtcaggggactcaagagggaggaattctgagaatctgagagtcttggatgatgggaaggcaaggaagatttctaggccagagaggattgttagggaaattgtttcagagtctatacctgtcatgacattgacaattcaggagcttactgatgatgtcatagcatcaactaaggaatacttgaggaatctcattgagaagcctgagaagaaagaggaactggtaagcctgcaaagccggctcgagagaagatctgaccttaccaaggagagtctttcaaagtgccataaggtgcaattagaggttttagtggctgtcaagatggggcttgctagcttcctatctagtcagattcagttgtctgagatggtagaggttttcttgtttaagaggtgtaggaatgtaacctgcaagcatttgcttcctgttgatgattgtgactgcaagatttgctcagggaacaagggcttttgcagttcttgcatgtgtcctgtctgtttgaactttgattgtgcaagcaacacttgtagttggattggatgtgatgtttgttcacattggtgccatgctacttgtggcattcagaggaatcttatcaagcctgggcctagcttgaaggggccttcagggacctcggagatgcagtttcattgtattggctgtggacatgcctcagaaatgtttggtttcgttaaggacgtcttcgtgtgttgcgcaaaggattgggggcttgaaaccttgatgaaagagcttgactgtgtaaggaagatcttcatgggaagtgaagatcgcaaagggaaggaattgcatgttaaaactgatgacatgctattaaagcttcaaactagaatgatatctccttcggatgccagcagttacatcatgcaatatttcagctatgcggacagcatgccagactttcctgcttctggtatttcttcaaaggatttgtcagcctctcaatctaaccttacaaaggatacaccatctctttcaaaacctaattctctattaccaaaatatggttatgacatgggctattctaggtcacatcctgatgccatgtcatgtgatctacttcagaaagacctcaaagcttccatcttaagtgaactgaaaaatgaggctgattttcatttgggggccttattaaggaaaggtggacttgaaagtttggagagcattgtgaggataaaggaggcagaagccagaatgtttcaaaccaaggcagatgaagcaagaagagaggcagaagggttccagaggatgatcaggacgaagactgcgcagatggaagaagagtacgccgaaaagctttccaaactctgtttgcatgagaccgaggaaacgcagaggaagaaattggatgaactgaaagtcttggaaaattcttattttgattactataagatgaaaaagagaatgcaagatgagattgatggtttgttgcggagaatggaggcaacaaagcagcaatgggtttaa

SEQ ID NO: 2847 - DNA, 117 bp, Glycine Max; identical to SEQ ID NO: 243

SEQ ID NO: 2848 - DNA, 1482 bp, Glycine Max; identical to SEQ ID NO: 244

SEQ ID NO: 2849 - DNA, 1497 bp, Glycine Max; identical to SEQ ID NO: 245

SEQ ID NO: 2850 - DNA, 720 bp, Glycine Max
atgcaaactcgggaatattttctcccagataagatgggacttcctttggctgatgagaccattgatcctcatatgcatgctccacttgcttctacctttgatgcatatttacctccaggtgtgaggcagataacacccattgaaagatttaaattgctaccctctgaggcttgccccaagaactttgtcatctttgatcaaacagatcaacaaagcaggatcatgttccatcctgcaatgacctacaaatttgacagtcctagcttacatgctcatgctactggttctcaagattttgagaagaacaaagtcaatcaaatggaaagagaattgtcatctgcttttgaagaagatcctaatgacattgatgcattgttgagcataggagcggatgaactagaagactttgacgaggaagaagtcagcacagcaaggactcgtgaaaaatatgaaagtttatccgatacttgctccagttattgctcaaaatcaaggaagaagaggtcatcatcatcatcttctgtacagaagtcttctggggctgggggttactgccacaatgaagggaagcaccaggagataaagaggatggtgaggatgttgagaaagattgtgcctgatggaggtaatcaaatggattctgttgctgttttaaatgaagctgttaaatacctcaagtctctcaaagttgaggttgaacaattcagggttgaaccatga

SEQ ID NO: 2851 - DNA, 270 bp, Glycine Max
atgcaaatagccacaaccaacgtgaacttgttcctcttgtttttgcttcttgtgttgaccctcatagcccaaggaacacgcctcgtgcttcctgcagcaccaagcgtgacaagtttgtatgatgcagatgtggagtcatcggagtcatcatcaatgccatggggatggattgtctctgccttgatgcttttggttctgatatccaaccgacttcaccctatctttgtaattgcaacagtggttgtttatgtgtattttttatcagcgtaa

SEQ ID NO: 2852 - DNA, 180 bp, Glycine Max; identical to SEQ ID NO: 246

SEQ ID NO: 2853 - DNA, 2649 bp, Glycine Max
atgcaacatggcatttcagtggaagtggaaaatccaaatggaagaagcatgttgcagtatcaaaagcgaagagactttcccatagacagcaacaagaagtactgttacacactaagcacagaagagagaagaagatatttggtgagagcaacgtttcaatatggaagcttggacagtggagacacataccctcagtttcagctctacttggatgcaacaaaatgggctactgtgtcaatttatgatgcctcaagagtatatgttaaggaaatgatcatcagggcaccctcaaattctattgatgtctgcatgtgttgtgctacgactggttctccttttatatctacccttgagttgcgacccttgaatctttcaatgtatgccacagattttgaggacaatttcttcttggaagttgctgcaagaataaactttggtgctccaactgaagatgctgtcaggtacccggatgacccgtatgatagaatttgggattctgatcttattaaaaggcaaaattatcttgttggggtggcgccaggcacagaaagaattagcactacgaagaacatagatatagagactagagaatacccacctgttaaagttatgcaaagtgcagttgttggcacaaaaggagtactcagctacagattgaacctggaagacttccccgccaatgctcgagcttatgcatattttgcagaaattgaagatttgggtcagaatgagagtcgaaaattcaaactaaagcaaccttatatagctgactatagcaatgcagtagttaacattgctgagaatgccaatgggagctacactttatatgaaccaagttacatgaatgtgactctcgaatttgttttatcattctcctttgttatggccccagattctactcgaggacctcttctaaatgcattggaaataagtaaatatgtacagattgcttcaaagacagacaagcaagactcaaccgttgtaactgcatttcaattattgtctgctgaaagttcccaaacaaacgaaggcgatccttgtgtcccaactccctgggaatgggtgaattgtagtaccaccacgcctccaagaattactaaaataattctttcgaggaggaatgtgaagggtgaaatctcacctgagcttagcaatatggaagctttgacagagttgtggttagatggcaacttgcttactggacagttacctgacatgagcaaacttataaatctaaagattgtgcatttagagaacaacaagttgacaggtcgactaccatcttacatgggtagtttgccaagcttacaagcattgttcatacagaacaactcatttagcggggaaataccagccggattaatatctaaaaaaatcgttttcaactatgatggtaatcctgaactatacagaggaaacaagaagcattttaagatggttgtgggaatttcaattggagtactagtgattctattaatattattcttagtaagtttggtgctattgcttaaaacacgtagaaaggcatctcaaaagaaacgtgaggaaaaaggcatttctggacgcactaatagtaaacctggatactcatttcttcggggtggaaatttaatggatgaaaatactacttgccatattacactctcagagttgaaagaagctactgacaatttttcaaagaaaattggcaaaggaagctttggatctgtctactatgggaaaatgagagatggaaaagaaatagcagttaaaagtatgaatgaatcatcttgtcacgggaaccagcaatttgttaatgaggtggccctcctatccagaattcatcacagaaatttggttcctttgattggatattgtgaagaagaatgtcagcatattctggtttacgagtatatgcacaatggcactttacgcgatcacattcatgagagttccaagaagaagaacttggactggttaactcgtcttcgtattgcagaagatgccgctaaaggtcttgaatatttacacacaggatgcaatccaagtatcattcaccgtgacataaagacaggaaatattctcctagacatcaatatgagagcaaaagtatcagattttggactctctagattagccgaagaagatttaacccatatatcaagcattgcacgaggaactgttggctacttggatcctgagtactatgcaagtcagcaattgacagaaaagagtgacgtgtatagttttggagttgttctgctagaactgatatctggaaaaaaacctgtgtcatctgaagattatggtgacgaaatgaacattgttcactgggcaagatccttaactcgtaaaggagatgcaatgagcatcattgacccttctcttgctggaaatgccaaaaccgagtccatttggagggtggtagaaattgccatgcagtgtgtagcacaacatggtgcctccaggccaaggatgcaagaaatcattttggctatacaagatgcaaccaagattgaaaaaggaacagaaaataagctaaaatcatcatcattttcaggtagtagtagttcaaagccacaacattcttcccggaaaactctactcacaagctttcttgaaattgagagccctgacgtgtcaaatggttgccttccatcggcaagataa

SEQ ID NO: 2854 - DNA, 704 bp, Glycine Max; identical to SEQ ID NO: 247

SEQ ID NO: 2855 - DNA, 1410 bp, Glycine Max
atgcaagcgcttcactctcccaccctccgcgcttctcccttggaccctcttcgtggccccaacaatgccgccgccaaccgccgctcctccagcgccaagcgcgtgttcttcgtctccgccacggtggcgccgaaggtgtccgccccgcagcgacagaaggaccccaagaagcgcgttgtgatcaccggaatgggcctcgcgtcggtgttcggtaacgacgtggagggttactacgagaagctcctcgccggcgagagcggcatcaccgccatcgaccgcttcgacgcctccaagttccccacgcgtttcggcggccagatccgcggcttctctgccgagggctacatcgacggcaagaacgaccgccgcctcgacgactgcctccgctactgcattgtcgccggcaaaaaggccctcgaaaacgccgaccttgcccccgacaaccactccaagattgataaggagcgtgctggtgttcttgtaggctctggaatgggaggcttaacggtgttttctgacggtgttcaggctctgattgagaaggggcacaggaagataacgccgtttttcattccttatgcaattactaacatgggttcggctttgcttgggatagaccttggattcatgggtcccaactactctatatccacggcttgtgctacttccaattattgcttttatgctgcggcgaaccatattcggagaggggaggctgatttgatgatagccggtgggactgaggctgccattattcctattgggttagggggttttgttgcttgcagagcgctttctcagaggaacgacgaccctaaaaccgcttccaggccatgggataaggaacgtgatggctttgttatgggtgaaggtgctggagttttggtaatggagagcttggagcatgctatgaagcgaggcgcacctattattgctgaatatttgggaggagctgttaactgtgatgcttatcacatgactgatccaaggtctgatggacttggtgtgtctacatgcattcagagcagccttgaagatgccggtgtgtcaccagaggaggtcaactacataaatgcacatgcaacttccactcttgctggagacttggcagaaattaatgctattaaaaaggttttcaaggacacttctggcatcaaaattaatgccaccaagtctatgatagggcactgccttggtgcagctgggggtttagaagccattgccacagtgaaagccataacaacaggatggctgcatccaacaatcaatcaatttaacccagaacctgcagttgattttgatacagtggcaaatgtcaagcagcagcatgaaatcaacgttgccatttcaaattcatttggattcggtggacacaactctgtggtggcattttctgctttcaagccttga

SEQ ID NO: 2856 - DNA, 1314 bp, Glycine Max
atgcaagcgcttcactctcccaccctccgcgcttctcccttggaccctcttcgtggccccaacaatgccgccgccaaccgccgctcctccagcgccaagcgcgtgttcttcgtctccgccacggtggcgccgaaggtgtccgccccgcagcgacagaaggaccccaagaagcgcgttgtgatcaccggaatgggcctcgcgtcggtgttcggtaacgacgtggagggttactacgagaagctcctcgccggcgagagcggcatcaccgccatcgaccgcttcgacgcctccaagttccccacgcgtttcggcggccagatccgcggcttctctgccgagggctacatcgacggcaagaacgaccgccgcctcgacgactgcctccgctactgcattgtcgccggcaaaaaggccctcgaaaacgccgaccttgcccccgacaaccactccaagattgataaggagcgtgctggtgttcttgtaggctctggaatgggaggcttaacggtgttttctgacggtgttcaggctctgattgagaaggggcacaggaagataacgccgtttttcattccttatgcaattactaacatgggttcggctttgcttgggatagaccttggattcatgggtcccaactactctatatccacggcttgtgctacttccaattattgcttttatgctgcggcgaaccatattcggagaggggaggctgatttgatgatagccggtgggactgaggctgccattattcctattgggttagggggttttgttgcttgcagagcgctttctcagaggaacgacgaccctaaaaccgcttccaggccatgggataaggaacgtgatggctttgttatgggtgaaggtgctggagttttggtaatggagagcttggagcatgctatgaagcgaggcgcacctattattgctgaatatttgggaggagctgttaactgtgatgcttatcacatgactgatccaaggtctgatggacttggtgtgtctacatgcattcagagcagccttgaagatgccggtgtgtcaccagaggaggtcaactacataaatgcacatgcaacttccactcttgctggagacttggcagaaattaatgctattaaaaaggttttcaaggacacttctggcatcaaaattaatgccaccaagtctatgatagggcactgccttggtgcagctgggggtttagaagccattgccacagtgaaagccataacaacaggatggctgcatccaacaatcaatcaatttgtacgtatacctaatattttaggtttaggattattatga

SEQ ID NO: 2857 - DNA, 1176 bp, Glycine Max; identical to SEQ ID NO: 248

SEQ ID NO: 2858 - DNA, 2202 bp, Glycine Max; identical to SEQ ID NO: 249

SEQ ID NO: 2859 - DNA, 861 bp, Glycine Max
atgcaattagcgaatgagagaatgaagagccggtggttcgtgtggcttttggcggtactaggcatcatcggagccacactcttcatagtgagcttgatccaaacctcggagaacaacttcctatgttccataacaagaacgatgcagcagcagcagcagcagttcaccgatggccccacatcgatgcaactcaaagccatcctccactacgcgacctctcagattgtccctcaacaatctctttccgagattacaataaccttcgacgtgctccaaagcctccaccgccccgccaacttcctcgtgtttgggctgggccgcgattctctcatgtgggccagcctcaacccccacggcaccacgctgttcctcgaggaggaccctaaatggttcgggatcgtcaccaaggaggcgccctacctccgggcccacacggtccgttaccggacacagctccgagaagccgacagcctcatgtcctcgtaccgatccgaacccgcgtgttttccggccaccgccacgctccgcggcaacgagcggtgcaaacttgccctacataacctccctgacgaggtttatgagaaggagtgggatttgatcatgatcgacgcgccgaaggggtactttgcggaggcgccggggcgcatggcggcgatattctcggcggcggtgatggcgagggacaggaagggatccggtgtgacgcacgtgttcttgcacgatgtggatcggaaggtggagaaggtttacgcggaggagtttctgtgtaggaagcacttggtcaaaggtgttgggaggctctggcatttcgagattcctccaatgggtaataacactcgtgactacgcacgtttctgttag

SEQ ID NO: 2860 - DNA, 780 bp, Glycine Max
atgcacaaattgggaagaggtcatcgtgacaaactccagcagttcataacaataactggagccagcgagaaactagccctgcaggctctgaaggctagtgattggcatcttgaaggagcatttgatttcttttacagccaaccccagcttaaaacatttactgattctaggcacttggaggagctatacaatagatataaagatgcatatgttgatatgattttggcagatggtatcactctcctttgcaatgatatccaggtggatcctcaagatatagtaatgttagttctttcatggcacatgaaggctggcaccatgtgtgaattttccaagaaggagtttattgaaggtctacaatctttggggattgattctctggaaaagttccgtgaaaagataccttatatgcgctctgagctgaaagatgaacagaaattccgtgagatatataattttgcttttggctgggcaaaagagaagggtcaaaaatctcttgcattggatactgctattggtatgtggcaattattatttgctgagaagcagtggccgctggttgatcattggtgccagttcttgcaggctcggcataacaaagcaatatctagggacacatggtctcagcttttggagtttgcaaagactgttggctcaaatttatctgattatgatgccgaaggtgcttggccatatcttattgatgaatttgtggagtatctcaacgagaatggcataatccaaaatgatctgatcaatgattctagtctaaaacgatga

SEQ ID NO: 2861 - DNA, 3294 bp, Glycine Max; identical to SEQ ID NO: 250

SEQ ID NO: 2862 - DNA, 1875 bp, Glycine Max
atgcacggaagggcgcaagagaagcgaggtttggatttggcttccgccgaagaaggtcagcctgatcggaaacgacctgcgttggctagtgtaattgttgaggccctgaaggtggacagtctgcagaaactttgctcatcactggagcctattctacgcagagttgttagtgaagaagttgagcgtgctttggcaaaactaggccctgccaagcttaataatactggcaggtcttccccaaagtggatagaaggccctgatggcaaaattttacaattgcacttcaagaccaggctatcccttcccctctttactggtgggaaagtggagggtgagcaagggacatccatacatattgttttgattgatgcaaatactggccatattgtcacatcagggccagagtcatgtgtcaggctagatgttattgtactagagggagatttcaataatgaggatgatgataattgggatgaagaagagtttgatagtcatattgtgaaagagcgggaaggaaaaaggcctcttctaactggtgatctgcaagtcacactgaaggagggtttaggtacacttggtgagcttacatttacagacaactctagctggataaggagtaggaagtttagattggggctgaaagttgcctcaggttgttgtgaggaaatgcgtatccgtgaagccaaatcagaacctttcacagttaaggatcatcgtggagaattatacaagaaacactacccgcctgccttgaatgatgaggtctggagactggagaagattggtaaggatgggtcatttcacaaaaggctaaataaagctggaatatatacggttgaagacttcttaagatttgtggtcagagaccctcagagattgcggaatattcttgggagcggcatgtcaaataagatgtgggatattcttgttgagcatgcaaagacttgtgttctcagtggaaaactttatgtatactatcctgatgatgcaagaaatgtgggtgttgttttcaataatatttatgaattaagcggcttaattgccaacgaccaatattactcagctgattctctctccgagaatcagaaggtttatgtagacacgttggtgaagaaggcatatgataattggatgcatgttattgagtatgatgggaagtctctgataaatgacaacgaggataagactttggataccactcatcctcaggctccaatgacttcccatgaatattcaaactcacttcagcagatatccatcccagctttgccacttccattacatcctggccagccttcagtggattcaggagtagccgttggaggttatcatgatgggacagcttccagattctccttgcaaccacatcctaatcttaattcttccattcagtttgatgataatgcatttccactgcaaaaccagttgatgagtgtttcacaccatacccaacttccaagaaatgaaaatgggcggactgttggtcctccacaatcatccacgcatggttttgagcctctcaccatttcaaatcctacttacagaggagctgaagagtacttcccagaggaggaaattcgtattagaagtaatgagatgctagaaaataacgatatgcagcatcttctccgtatttttaacatgggaggccaatcacatcctacccttaatgctcaggatgatgggtaccctagttcatctacatacatttctgcaaaccccatgggctacaattttgatgatgaaccaaaccgttcctcgggaaaagctgttgtgggctggctcaagctgaaggctgctttaagatggggtatttttattcggaaacaggctgctgagagacgtgcacagctcgttgaactggatgacccatag

SEQ ID NO: 2863 - DNA, 3606 bp, Glycine Max
atgcagaaacatcaatacaattccatggaacctcgaaatgaggaattccattctgcaccacagttggtcccgcaagaccttcgtgatggcatgcatatcaatgcacgacctccgccatttaatatgtcagaaaataaacctgtacttaattactccatacagactggtgaggaatttgctctcgagtttatgagagatagggtgaatctcaggaagcctgcctttccaaatgttgtgggtgatcccaattattcaacaggctatatggaattgaaaggcattttgggccaccctggatcagagagtggatcagatatttctgtgctcacaaaggttgaaaagggtccaaaagagtttgacagaaggaactcttctcaacaccaggacagaagtaattatggttcagctcaatccattcctagatcttcatctaatcaagacagttaccgagttcttcatggtacttcctcttctagtgtttctgaaagcgcatcaatgaagatgaaggttctatgcagctttggcggtaaaatattgccacggcctagtgatggaaagcttagatatgttgggggtgaaacgcgtattattagtataagacgggacatacgttttcatgagcttatgcttaaaacatcatccatctataatgaaactcatgtgataaagtatcagctccctggagaagatcttgatgcattggtttcagtatcttctgatgaggatctgcggaatatgatggaggaatgtcatgatctacaaggcggccgagaatcaaataagcttaggatttttctgttatctatgaatgatttggatgatactcagttcggtataggtagcatggatggtgattctgaaattcagtatgtcgttgctgttaatggtatgggcatgggttcaagaaacaactcaatccttcgtggtgaaagtggctctactaataacttacatgaattgaatggacacaataatgagagggagaccaacagagttctcatggacacatttggtgttagcagttcatccttgactgacaatgttaaaccatcactggctattcaatcttcacaaccagtgcttccaatctcctctaatgcttatgaaacccatccattgttttatgatgagcagattattcaccacggggaagctagtcattatccactacagcatggccttggtccttctaacaactccgctcacaatcttgaagagattccagtttctatgccaactcatggccttgtcaaccaaggaatcatgaatgatggacaagcatccagtcagttgcaggtacaaatttcagctatgccagaaacgctgccatttgagggcaatttgcatgctaatatatcagatgcttcagctacagctgctatatcagaagggcttcatcctgcattaccatcaaagaacaagggtaagcaccagcagtctgaagatgcctcttcattaattagtagtatgaatcccacacagactcccaagtctgttgaagatgacttctttactacagccactgatgcattcagccatgctcatgttgatgccgagtccaatgtaattgatttcagttaccttgaaccacctccacttcccaacagagtctattattcagagagaattccaagggagcaggcagatttgctgaaccgatctacaaagtcagatgatgctcatggttctcacttactcatgtcagatttgctttctgacttcagccagaaaaattcaattacagaatccactgacatctcagcaggaaagcctttgcaagcagatggccataccattgatgatggatttgccccgccacagacatacaaacagttgcctgatacaacaattaaggtgaatccaaagttatcacagcatgtgaattctgagtcgaagcaagtgctagaagataataaagtttctagaaatgaggatcaggttcttagttctgaaaacgaaaccaaaggcaccgaacatcttgcatttcatcaagttccttctgttgaacaaaatcagaatctagcatctaaacttccagacctcaatttggctgaggtttctaccagggagtctgataatgatactaaggtccaatcccagacttttcctttaactggaaacacaggccaagatgtttctcaagattttcccccagaagctaaatccagacctactcagggtgacattctgattgatatcgaggacaggtttccccgtgatttcctttatgacatgttctccaaagcaataatttctgaagattcctcaagcattggtccattaccaacagatagagcaggtttgagcttaaatatggacaatcatgagcctaaacgttggtcatattttcagaacttggctctagaggggtttgataatgtatctctaattgatcaggataatcttggtttttcgtctgctgtgagaaaagtacaagagggggatagtaaatctcagccatctgctcctcaaccagctggtggtgttttggcaggacgcacagattcccacctaaatattggtgaagaaaatcagaaaaatgtacctgtagcaactaaaacagaagcaagtatctttcaccaaaaatatgagcattcccaactaaagggcaatgaaaataagaacatggatgccataatggaaaacatacgaccacaggagtctgaataccaggatgacaagaatgaaccgaggaatgtggttgtagcaggggaatttgacaccagtactgtgcagttcataaagaatgaagatcttgaagagttgcgagagctgggttctggtacatttgggactgtgtaccatggaaaatggagaggatcagatgttgcaattaaaagaataaagaaaagctgcttcgctggtcgatcttcagaacaagaaagattgaccatagagttctggcgggaagctgacatactttccaagcttcaccatccaaatgtggtggcattttatggtgtagttcaggatggaccaggagcaacattagcgactgttaccgagttcatggtggatggttctcttaggaatgttttgcttcgtaaggataggtatcttgatcgccgcaagaggctgataattgccatggatgctgctttcggaatggaatatttacactcaaaaaatattgtgcattttgacttgaaatgtgacaatttgctcgtgaacttgaaggatcctatacggccaatatgcaaggttggcgattttggcctatcaaagattaagcgaaataccttggtgtctggtggtgttcgtggaactctaccttggatggcaccagagctgctaaatggtagtagcaataaggtctcagaaaaggttgatgtgttctcttttggcattgtcttatgggagattcttactggtgatgagccatatgctaatatgcactatggcgcaatcataggaggcattgtgaataacacattaagacctacaatccctagttattgtgatcttgagtggaaaacactaatggagcagtgttgggcacctaatccagcagtaaggccatcctttgccgaaattgctcgccgcttgcgtgtgatgtctgcagccgctagtcagatcaaaggacagggccacaaggcatctaaatga

SEQ ID NO: 2864 - DNA, 528 bp, Glycine Max; identical to SEQ ID NO: 251

SEQ ID NO: 2865 - DNA, 534 bp, Glycine Max; identical to SEQ ID NO: 252

SEQ ID NO: 2866 - DNA, 189 bp, Glycine Max
atgcagagtgtgtctagtcccacaccgactatagataaggccaatgtaatattttataaagcttggacaatcctcaccttacaagctgattttgtaaagttgagtaaggccctaaactccaattctaacaagatttcagagccttcaattcattgttggcgcacctgcattaccactccgaacccatag

SEQ ID NO: 2867 - DNA, 2013 bp, Glycine Max; identical to SEQ ID NO: 253

SEQ ID NO: 2868 - DNA, 7929 bp, Glycine Max
atgcagcaagttccctcacttcatcggcttatgatgaccgaaggcaaggtgaatgcttttgtccattgctttgtcggggtccagaggatcacttcattgtatgatttggaagtggcaatatgcaagaatgagggtgtcgatgactttgaagagctagggttgggacctttcttgcggcaccccttggttattcattatttctcgcttcgctctgatgttacccaggtgtataagattaccactgaggaaataattcagttgctaattgagtttttggatgcttctagaagtaatgaattcatcaaggttgaacagtttttggattttattgccaacaagcgattggttgaatgcaaggaatggcttgggattcggattcagaacttgggaatgcatatatatgccatacgggaagctagaaattcagagcaatctgccatgcgggaagttagaaagttagggcaatctgctcgacgggaagctagaaagttagggcaatctgctcgacgggaagctagaaagttagggcaatctgctcgacgggaagctagaaattcagagcaatctgccatacaggaagctagaaattcagagcaatctgctgtacaggaagctagcaattcagagcaatcagcatacgagaaatgcttggagtcatttttgaaaaatgggaagttccggtaccgtactattccttcctctcagaaaaaacagttagatgaacgttttaatgccattactcagcgtgttgagtctttttctcctgtaaaaaagtctttttgtggaaagcataaaagatttatgtcatcagcctcagaagatgaagatagtgattcttctacagatgaacaaagtaataacatcattaagggtagccagtcaaacccatcatcacaattcactagaagttcagaacgagtgagtagttgcccttacccatctgcaactgaagagaaggctcgacttggggtgaggagtgatatggcggggcactcccttgttaatagcaaccttaaaaaaggatttagtgagcaacctagaaaaaaaagaaaatttgaaaatgcaacttctacaagatctgctccttataagttgcgtaagagaaacaaacttggagttgtaaccccaatcaatactggtaacaaaaccaaggtatcaaccaatattgatgaagatctttcaatttctaatgattctttgcagatgtttgtcacaacctggaagatggcatgttcggagcacaaggttgccgaggtttcatctatcaaatctggaatgaggaacaacatctatgataccttccaagctatcatcgataatggattgggcaactcaccgaccaagggttctgaatacgatactatagacgttggaccaggccaggaaaatgtaccggtcataactaaggataacacagagaatacaaagtgtatttcttctgatgatgtcatcagaaaaattggaacttattttgaccatggcaatgatataaatagaaatagtaacgactcactagtgcaatatagaattatgttgtggaggaagttttgcagctgtgaaaattgggtggctgagcagtttggtatgaaaaaattcgattctcttggttatggagatttcttatcattccttgagaagcaccctaacctgttacctcatgaactactgaagttgttggttggtgacacgtgcgaaaattcctctttcagggcctgtatgtcctcaaatcaattgattgctctagtatctcaggctctaagtggtttgtgggagaatgaaacaataaccaagcaaatgatatccatgctgcttatgaggcagttcccttcaattaattttgaacttgtggaaaatggctctcttgtggatctgctggatactgttaaggggcatacatctagcgtgacttcaaaatgtgttgtattttctgctactattatagaaaagaactataatggagactcatcaagtgatagagataacaattggtcagaaattcccactgataggtctgaaacgagccataaaaaaagcactgaaactgttatagcaaaaaatgcaattgaagtcttgctgaaggcgccaatgttgtctgacttgagcaagtggtctcattgggatcttaggtttgcacccttcctaggtccatttatatcgtggctgttgaatgatgtaaataccaaggaactgttttgcttagttaccagagatggaaaggtgatacggatagatcattctgctaccttggactctttcctggaggctgcagttcaaggatcctctttccaaactgcagtgcatttgctgtctctgatctcacttgttgggggagaaaaatatgttccattgtcacttctaaaatgccattcctgccatgcatttgaagttatgttcagaaactctgtagaagatgttgaagttagtaatgatgggaatgctctccaccagtctgtggaagcattaagtaaaacaaaatttttaactgaaatttcaactgctaaaatgagaagtgtgtttagcaaacacatgcataaagtgagtaaggtagcatccattctgtcaaggtttgtccttgattgtcttggtaacttaccggctgaatttcacagttttgcttctgatgtgttgctttctgggatgcaatctgttttcaaggatgccgcttcaactattttatgtgaatgcagcaatatggagcaacgtctcatgcttcatgaaatagggttatctctgggtatttctgagtggattaatgattaccatgcacttatttcaaacaactcttctgacattcattgtgctcgtgtttcatgcttaaaagatgccacaactgatataaacacaagtctgaagcttgaccaagttaccttggataagtctcctatacctgaagcaaatatggttacatctcttgtaccccatcgacttattgaagggtgtacagaaatcattgaaacagttgatccagaaaaatctaatgatgaatctaacacttgctgtctgggaaattcatttcaacatgtcgaagatatggatgcttctcggcttattgaatctattaggcgagatgaatttggcctagattcaagtctttctgatattgatagttgcatgttgaagaagcaacatgctcggttaggtagagcactgcattgcctttcacaagagctatattctcaagattctcattttattcttgaattggttcaaaatgcagatgacaataattatccagagaatgtggaaccaactcttacatttattcttcgagattctggtattgttgtattgaataatgagcgaggtttctcagctcaaaatatgagagcactttgtgatgttggaaattcaacaaagaaaggatctactgctggatacatagggaagaaaggcattggtttcaagtctgtgttccgagtcacagatgctccagaaattcattccaatggttttcatgttaaatttgacattagtgaaggccagattggttttgttttgcccacagtagtacctccttgtgacattggggtgctcaggaggatggcatctactgatactgaattgtgtgacgataatccctggaacacatgcattctgcttccattcagatctcatctatcagaaggaatggccatgaatagtgttttgtctatgttttcagatcttcatccttcactgttactatttcttcaccgcctcaagtgtatcaagttaagaaacttgcttaatgatacacttactgttatgaaaaaagaaatttcaggagatggtatcattaaggtttctcatgggaaagagaaaatagtgtggtttgtagtatctcagaagttgcaaacaaattccattcgctttgatgtgcagacaactgaaatttctatggcgtttactctgcaggaatcagataatggttacattccatgttcagatcagcagccagtttttgcatttcttcctttaagaacatatggcctgaagtttattcttcaaggtgattttgttcttccttcatctagagaggaagttgatggagatagtccatggaaccagtggttattgtcagagtatcctaatttgtttgtcagagcacagagagagttttgtgaacttccctgttttaggagtgagcctggaaagggactgtctgctttcatgagttttgttcctttagttggggaagtgcatggttttttctccagtcttcctcgcttgattatttctaaattacgtatgatgaattgcttacttgtggacggtgacaataatgaatgggccccaccatgcaaggtattgagaggttggacagagcaggtgcgtaatcttattcctgacaacatgcttcttgaacaccttgggcttatatacctggatagaaatatagtattgtctgatgaactagcaagggcactaggcattgaggagtttgggcctaacattcttgttcgagtactgtcatctttatgccatacgaagagtggtctgatatcgatggatatgagttggttagcttcttgtctaaatattctttctgtaacaatgttcaattcgtctggctctgtgccaatcaattttgaaatgaaagatgttcagaaaaatcttcaaaaaatgccatttattccactttcagatggtacatacagctcagtggatgaaggcactatatggttgcatttcaatcatttaaacacaggatttgatggtgagcataaaattgaagctttccctaatatatgtgctaaactaaggactgtaagtcctttccttttttctgcatcttctggtactccgagcttgaatgtgacatttttggacaatgttacccggttacttcagagtattggtgttcaacagttgtctgtacatgatgttgtgaagctgcatattttacctgcattgtctgatgaaacaatggcaaacaaaaacagagtgctgatgattgaatatgtatgttttgtaatgctacacctgaactcgagctgttctgattgttttattgaaagggagcatataatatccgagtttagatgtaaatctttgttattgacaaattatggtttcaagtgtcctgctgagataccaattcatttctgtactggatttgggaatcctgtcactccaaaaatgttggctgatagtgtgagtatgaggtggcatgaggttgacataagctatttaagccacccagtaaatgaatcagtttcatctgcactgattaagtggagggatttttttgagaaatttggcatcacagattttgctcaagtagttcaggtggataagagtgttgtcgatatatgtgatgtcacatttaagcagatgatgtgggataggggtctaatatctgctgagtcaatagtcaaagattgggaatcctctgaaattgtgcaattagtatccttattgtctaaaagtggcaatctagaaaattgtaaatatctcttggaggttcttgatacattatgggatgtttgttatagtaataaaactacgggttatttctatcttaaatctgttggagatggccatccctttaagtctacttttatatgcagcctgtgtgatatccagtgggtggtttcaaccatggatgatgagctacactatcctaaagatttgttttatgattgtgaaacagtccggatgctccttggagattttgcaccatatgctgttccaaaggtgaaaagtgaaagattggtaaaagattttgggtttaagactagagttactctcgatgacatttttgatgttcttaaagcctggagaaaatcatcaaagactccattcaaggcgagattcttagaatgtggattttggcctaactcaaccccaaaaaagctagttcattgcataacacaaatgaccaaattgtatgcattcatttggaatgaaatggcatcttcaaagaagaaaactatggaaggtttgatgtctggaccttttatatttatcccatactcatctgtctatgatcatgatgatgctgcatgtgggacgtttgtgtctcccaatgaagtctattggcatgattcaactggttctattcagaaaatgaaggagttccatcctcaatgtggctcatcttcttcccctataaacaagtcattatgcaatatttaccctagtcttcgtggtttctttgttgatgaatgtcaagtacaagaggcacctcctctatgcagctatattcaaattatgttgcagttatcaactgttactttgccttcacaagcagcagataaaattttgcaagttttcctcaagtgggcagatggactaaaatctggtttgctgagtgttgaggatgtcacatatctcaaagaatgtctttcaaaattggaatttccagtgcttcccactgtgcaagataagtgggtttcgttgcatccttcctttggtcttgtctgctggtgcgatgataagaagttgaaaaaggaatttaaacattcagacaacctcgactttctctatttcggtgaactggttgaggatgataaggaaatggggcaagaaaaaatttccatcctcatgaaaaacttaggtattccagctatctcagaggtggtaactcgggaaccaatatattatggtcttgctgattgtagtttgaaaaagtcattggtaaactggactctgccatatgcccagcgctacattcataaatttcatattgataaatatgataaactcaagcagtctggttttgatattttcaaccatctgaatgtcattgttgttgagaagctgttctacaggaatgttataaagacctgtggcagtgtatcaaaaaaacgagtcgaatgtagttgtcttttgcagggaaacattttgtacaccattaaagaatcagattatcattccttgtttatggagctttctagtttgttactaaatgggacttctgaattgcacttggcaaatttccttcatatgataacaaccatgacagaatctggttcctctgaggagcaaatagaatttttcattttgaatagccaaaaagtaccaaaacttccagatgaagaatctgtttggacattatcttccgtgtcatcaattgtagaggctgataagttgaacccttcagatcatgtcccatcaacaaatgaacagatctttcctagaaggaagcccggagtatgccccaactggccacctgctggttggaaaactgcaccagatttcaggtatgcccaggccaatggtttcaagaccaaaccttcccagattagcagcttttctgaaatgaagaaggatgacaattcagcaagcataatttctccaccagtttgtgctgaacaaggatcagttactgttgactggaccttcaaagaagatccaccagcaagttcagtggcactagtgttgcatgaaaatgataactttgaagatcaatcttgtcatgattttgatcccactgcttttagtatccatgctgattctgatcctgttagtttggatgaatctctggatgaagctcatttcagttcaccagcttttggcaagagagatcaattacaaactggtacatttgatgctgcacaagcaaaggaaactggcagattaggtgaatttcttgcatgcaaatactttgtcgataaagttggcaatactgcagtaaggtgggttaataaagataatgaaactggacttccatatgatttagtcattggggaggataacagccaagaattcatagaagttaaagcaaccagatctccaagaaaagactggttcaacatatcagcgagagagtggcagtttgcaaatgaaagaggccaatcttttagcattgcatttgtcgctataatgggaaataatgttgcaagggtcacgatattcaaagatccagtgaagttatgccagcgaggtgagctgcaattggctgttatgatgcgaagacaacagaagcagttctctgttgtctcatag

SEQ ID NO: 2869 - DNA, 714 bp, Glycine Max
atgcagcacaggaacattgttaggttgcaggatgtagtacatgatgagaagagtttgtatctggtttttgagtaccttgacttagatctaaagaagcacatggattcatctccagaatttgcaaaagatccacgacaactaaaaatgttcctgtaccaaattctctgtggcatcgcttactgtcattcacgtagagttcttcatcgagacttaaaaccacagaatttgttgatagatcgcagcaataatgcactaaaacttgcagattttggattggctagggcttttggaattcctgttaggacatttacacatgaggtggtaacactgtggtacagagctccagaaattttgcttggatcccatcattattctaccccagttgatatttggtcagtgggatgcatatttgcagagatggtaaatcaacgacctcttttccctggggactctgagattgatgaattgtttaaaatattcagaatcatgggtacaccaaatgaagacacatggcctggagtgacatcattgcctgattttaaatcagccttccccaaatggcagcctaaggacctgaaaattgtggttccaaatctcaagccagctggtcttgatcttctttctagcatgctttacttggatcccagcaaaagaattactgctaggagcgctcttgagcatgaatacttcaaagacattaaatttgtaccctga

SEQ ID NO: 2870 - DNA, 522 bp, Glycine Max; identical to SEQ ID NO: 254

SEQ ID NO: 2871 - DNA, 192 bp, Glycine Max; identical to SEQ ID NO: 255

SEQ ID NO: 2872 - DNA, 1203 bp, Glycine Max
atgcagtcaacagcagcaccaccactctatcaacttgtgagcttcaagccaaagcttcaaactttcccttcaaaatctcaactttgccccttagggacccctttctgcagactagaaatggcttcaatttctgggtttgggctgaaacccctgagggctgtgagtgtttcttcttcatcttctgcatcaagtgatgatggatttgtcacactgacagagtatgtggggaaggaaggaatgaatgtgaaagatgatttggtggtgttgcttgatcatattcagtatgcttgcaagaaaattgcagcacttgtggcttctcctttcaattacagccttggcaaacaaactgctcttggttctgttggttctgatagggatgctccaaagcctcttgatattgtctcgaatgaaattatcttgtcatcactccgaaaatccggaagagttgctgtcatggcttcagaagaaaatgacgcaccgacttggataagtgacgatggtccatatgtggttgtaacagatcccctagatggttctcgaaatattgatgcatccattccaacaggcacgatttttggtatttataagcgccttgaggaactagatgatctacccacagaggacaaagctatgctgaattcactccagagtggaagtaggctgattgctgctgcttatgttctctattcttctgcaactatactctgcatcacctttggttctggaacacaggcattcactcttgatcattcaacaggagactttattctcacaaatccaagcatcaaaattcctccccgtggtcaaatttattcagtaaatgatgcacgatattttgactggcctgaaggtttaaggcaatatatagacactgttagacaagggaaaggtagataccccaagaagtactcagccaggtatatatgttctctggtggcagatctccacaggactttgttgtatggtggtgtggcaatgaatccaagggaccatcttcgtcttgtttatgaagcaaaccctcttagtttcattgtagagcaggctggtgggagagggtctgatggcaaaaataggattctttcccttcaaccagttaaacttcaccaaagacttcctctatttttgggaagcttggaagacatggaagagttagaaagttatggggatatccaacaaaaagttaatcctggttatgaggtttga

SEQ ID NO: 2873 - DNA, 4068 bp, Glycine Max; identical to SEQ ID NO: 256

SEQ ID NO: 2874 - DNA, 801 bp, Glycine Max
atgcatatcctttgcaaaccaatttacattgttgtggcttcattttatgcttctgttcttctattcagtcactgcatggcctatgaggaggaacatcactctagtagtcacaaaagcactaataacaaaatttacaaggtaaatcagcagaagacatctgatattgcagtacatggattgctcctgtgggcttcaaccgggtttttaatgcctcttggcatacttatcatcagaggatccattaaagcagaacctggatccagaaggagtatagttctcttctatctccatgttggttttcagatgctttcagtgcttcttgccacagttggagctgctatgtccctgaagaagtttgagaattcatttgataacagccatcaaaaactaggcctagcactttatggtgctatattggtgcaaggcttgattggatttttcagaccacacaggggaaagaaggagagaagttattggtacttactacattggatactagggacaatagtttctcttgtggggatcatcaatatttacactggattaaaagcctaccataagagaaccttaaaaagcacaacactttggactatccttttcactgtggaagtctctttcattggattagtttacctcttgcaagacaaattggaatatatgaaaaagcaaggagtgattattggaagtgagtcgtcaattgtgtcatctaaccaagatattcctcaaagccaaacccaaaaggagttgttgccagttgcatgtggaagaaagagaaatgcacttgagaatttgtttgattaa

SEQ ID NO: 2875 - DNA, 690 bp, Glycine Max
atgcatcaccctgtcgacatcactcgctgtcaagaactccccgtctgtagtgttcctttgatggaacgcaggttacagtcggtactggaggagaacatgggaatctcgaagctattctcggttcaagtcgcactttggcaagaaacggttggatcagatgactttgagcgagacctttgcataaactcgcccaccgaaagtggcaaaaccttggcttatgctcttcccatcgttcaaaacttgtccaccaacaccagtgaccgcctctttgctttggttgtagttcccactcgtgaccttgctttgcaggttaagcgcgtcttcgatgcccttgcatcatcgctgggtctccacattggcttggctgctggtcaatcttcgcttcgccacgagctttctagcctcatttatctacctggagaagacgacggtccagatcctggttttttgtctcctttgtggttccaaagcaaggtcaacatattggtagcgacccctggaaggctaatggaccatgttaacaagttgtcgttgaagcatcttcgttatctcgtggttgacgaagcagatcgattgctacgcgaggactaccagtcctggttacctactgtgcttaaattgacccagtttaggcttgcaaagatagttttatctgttatattaactctggacccaggaagacttgcttaa

SEQ ID NO: 2876 - DNA, 1365 bp, Glycine Max
atgcatcattttgtgctaaccttattctttttagtttccactatgttggttgatgctagtaaaagcctaatgggctttagcatcgatctcattccacgtcactctccaatatccccattatataactcccaaatgacccaaaccgagttagttaaaagtgctgccttacgatctattactcgatcgaaacgagtaaattttattggtcaaatttcaccaccattatcaccgtcaccgtcaccatcatcatcaccaccatctccaccatcaccatcatcatcatcatcatcacctgctgaaagtatcataactcctatccctgaccatggagaatacctaatgagattctctttaggcactccgagtgttgaaaggcttgcaatttttgacacggggagtgatctctcttggctacaatgcaccccttgtaaaacatgttacccgcaagaagcaccattgtttgatccaacccaatcttcaacctacgtggatgtgccatgtgagtcacaaccatgcacactattcccccaaaaccaacgcgagtgtgggagctcaaagcaatgcatttaccttcaccaatatggtacggactcattcaccattgggagattgggctatgacaccattagttttagttcaactggtatgggccaaggtggtgccacatttcccaaatctgtgtttgggtgtgccttttatagcaatttcacgtttaagataagtaccaaggccaatggctttgtgggccttgggcctggcccattgtcactagcctcgcaactaggagaccaaattggccacaaattttcctattgcatggttccttttagttcaacctctacgggaaaattgaaatttggttccatggcaccaacaaatgaggttgtgtccacaccctttatgatcaatccttcttacccttcatattatgtcctcaacttagagggcatcacagttggacaaaaaaaggtgttgactggtcaaattggtggcaacataatcattgattcggtgcccatattgacacatcttgaacaaggaatttacaccgattttataagttcggtgaaggaagctattaatgtggaggttgcggaagatgctccaaccccatttgaatattgtgttagaaatccaactaacttgaatttccccgaatttgtgtttcattttacaggggctgatgtggtcttaggcccaaagaacatgtttattgccttggacaacaacttagtttgcatgacggtggtgccctccaaaggaatttccatctttggaaattgggcacaggttaattttcaagtagaatatgaccttggagagaaaaaggtttcttttgcccctaccaattgcagcaccatttaa

SEQ ID NO: 2877 - DNA, 795 bp, Glycine Max; identical to SEQ ID NO: 257

SEQ ID NO: 2878 - DNA, 1356 bp, Glycine Max
atgcatgatcaaaccggttgctttgatcccaacacaacgggagaaagtgtaccctctctgaaggataactttcctcaaactctacctccatcatcacctatggttgttgtaggaaacaccaccacaaacagcatcaataatagccttgaagagaatctcaggctttctgtggaggagctctcctgtaaccatcacaatccacaacaccaacaagatcatgtctccacctatgcaagtggagtaactgccacatctattgaaatcccacttccacagcatcttggtttgaacatgggaaactcctacatcaacaacaacaacaacatggataatcatttggtgcaagaggtcattgatgcatttccctatcagcagtccacttgggaccctactattcaatttgagactcaaaactgcagccaaagctacaacaacccctcttccatactagaccctccttacccttcaccagatctcctaaaccttctccacatgccaagatgctcagcctcatctttgctcaccaatccctccatttgcctcacaaacccaactcagaacacaccaaactttcagaatccaatggcctttcttggagatcttccaataggatcagaaaacacaagtgcatcctcagttttgtatgatcctctattccatctgaaccttcctcctcagcctccagcactcagagagctgtttcagtctctcccccgcggctatagcttgccaacaaactcgaggaatggctcactctttggtggaggggatgagatggagggtgatggaagccagcttgacatgggagtgctggaattcaacagggtcacactcacaccttctgttggcaaaggaaggagaggcaaagctaccaaacattttgcaactgagaaacaaagaagagagcaactcaatggaaaatacaaaatcttgaggaatctcatcccaagccccaccaagactgatagagcatctgtggtgggggatgccattgactatataagggagctgattagaacagtcaatgagctcaaactactggtggagaagaaaagatatgcgaaggacaggtgcaagaggcccaaaacagaggaagatgctgctgagagctgcaacattaagccttttggtgatccagatgggggcataaggacctcatggctccagaggaaatccaaagacagcgaggttgatgtccgtatcatcgacgacgatgtcacaatcaaactcttccagaggaagaagatcaactgcctgctgtttgtctccaaggttctggatgaacttcagctggagcttcaccatgttgcaggtggacatgttggtgaatattgcagtttcttgttcaatagcaag

SEQ ID NO: 2879 - DNA, 1323 bp, Glycine Max
atgcatgcttttgtattttgtttcttactcctatgttcacattctattgcatccttcgctgaagcctccaaaactctaagtggcttcagcatcaatcttattcaccgtgaatcaccattgtcacccttttacaacccttcactcaccccatcagagcgcatcaagaacactgtcttgcgctcctttgctcgctccaaacgtcgtcttcgcctatctcaaaacgatgatagatcacccggaaccattaccattccagacgaacccatcactgaatacctcatgaggttttacattggcacccctcctgtggaaaggtttgctattgcggacacaggaagtgatctaatttgggtgcaatgtgccccttgtgagaaatgtgtaccccaaaacgccccattatttgatccaagaaagtcttccacattcaagactgtgccatgtgactcacaaccttgcacactactccctccatcccaacgtgcctgtgttggaaagtcaggtcagtgctactaccaatatatatatggtgaccatacattagtctctggaatattgggttttgagtccattaattttggttccaagaacaatgctattaaatttcccaagcttacttttggatgcacattttccaataatgataccgtggacgagagcaagagaaacatgggtctagtgggtcttggagtagggccattgtcactaatttcacaactagggtatcaaattggtcgcaaattctcctattgtttccctcctttgagttcaaactccactagcaaaatgagattcgggaacgatgcaattgtaaaacaaataaaaggggttgtgtccactcccctcataatcaaatctattggaccaagctattactacctcaatcttgaaggcgtcagcattggaaacaagaaggtgaagacaagtgaaagtcaaacagatggcaacatattaatcgattcagggacctctttcacgattctcaagcaaagcttttacaataagtttgtggctttggtgaaggaagtgtatggtgttgaggcagtgaaaatccctccattggtatacaacttttgtttcgaaaataagggtaagaggaaacgtttccctgatgttgtgtttcttttcacgggtgctaaggttcgcgtggatgcttcaaacttgtttgaggccgaagacaacaacttgctttgcatggtcgcattacccacctctgatgaagatgattccatctttggaaatcatgcacaaattggttatcaagtggagtatgatcttcaaggggggatggtttcttttgctcctgctgattgtgccaaagactag

SEQ ID NO: 2880 - DNA, 345 bp, Glycine Max
atgcatggggagttgcatgtgacatatttgctgctggattacctgattcagtttaagacctattggaaagttttgttggtgttggatggctgcaaatggcttacctacaattgcactcaaatatgcataccactcttgttttcttcacggggggcactgattgaaggggttccattttctatgattgtggcactttgtttgggagatcttgatgcgttgagcaactacgatccattgctgtttttacattgttgctctatgtggtggaagattgctctcatcgaacattttacctgcctgcatgtgatgttttgtttgctgagatccagtttgtccttaccatag

SEQ ID NO: 2881 - DNA, 825 bp, Glycine Max; identical to SEQ ID NO: 258

SEQ ID NO: 2882 - DNA, 468 bp, Glycine Max
atgcattctaaaccctcatctatcacttccaattaccctctcatttctgccattgttgcttttgctctagctcaatccatcaagttcttcaccacttggtttaaggatagaagatgggatctgaagcaattagttgggtctggtggaatgccatcatctcattcagcaactgtcactgctcttgcagctgctattggattgcaagaaggctttggaggacctctttttgccactgccttggtttttgcttgtattgtgatgtatgatgctactggtgtaagattgcaagcaggacgccaagcagaggttttaaaccaaattgtgtatgaacttcctgctgagcatcctctggccgaaagcagaccacttcgcgaacttcttgggcacaccccccctcaggtcattgtcggtgggatacttggacttttaacagcaattggccttttaagacctgtgaccaagaattga

SEQ ID NO: 2883 - DNA, 4260 bp, Glycine Max; identical to SEQ ID NO: 259

SEQ ID NO: 2884 - DNA, 438 bp, Glycine Max
atgccaaaagtaaagacaaatcgtgttaaatacccagagggctgggaattaattgagcctacactccgtgaacttcaagcaaagatgagggaagctgagaatgatccgcatgatggcaaaagaaaatgtgagaccttatggcctatatttaagattgcacaccagaagagccgctacatatttgatctataccatcggaggaaggaaatttctaaagaactgtatgaattctgtttagatcaaggatatgctgaccgcaatctaattgcaaaatggaagaagcctggttatgaacgtctttgctgcctgaggtgcatgcagccacgtgatcacaattttgccaccacttgtgtttgcagagtacccaagcaacttagggaggagaaggtcatagagtgtgttcactgtggatgcaagggttgtgcaagcggggactaa

SEQ ID NO: 2885 - DNA, 438 bp, Glycine Max; identical to SEQ ID NO: 2884

SEQ ID NO: 2886 - DNA, 645 bp, Glycine Max
atgccaaacccaccatgtctagcggaagattctatcaaatactacaaaccaaaagatcatacacaaaaaacaaagggtttttccatctttgcctctgtcctttctcttattatctacatctctttgttctatatttttaatatctccccatacactctcttaaacaactacatcttttggttttttttatccaacaatatcatcctcattatagccgtagactctggagtattctcttcattggaacaggaacaagatccttatgaacaataccatgtctccaactaccaacaagttgatgataaaaaatgcatcaaccccaagatggttgtggtgcaaaatgaattgccaaaggaaattagtgaaggatactccaataatgtgaaaaggccgttacttccattggaagtacatgatagtgatagagcatgtaaagagaaacatgtccctgccagatttaaatgtgatagaccacatagaattaagcgtgtgaatgatgagagcatgaagaggagaaggtcagcaacaacgaagatagaagcagaagtagatgaagagaatgagtttaatagtatgacaaatgaggagctcaataggagagttgaggagtttattcagaaatgcagattagacttcaggcaatga

SEQ ID NO: 2887 - DNA, 1650 bp, Glycine Max
atgccaactttgattacatctaggggtttggccacttctaggtctgttttattgcacactagtagtgtccagtgtatgagccaggtggaacctcatcatggttccgtcaccctctctagcataggtttgcaaactgaaactgaacctagaaacagaagcaaaacaaataaggttaagccattgggttcaccctctgagaatctcaagagcaaagggaagcccttcggcattaatgagaagaaaaaaacttttagggttgtagagaaacagcaaatagagtctgccccttttgctgcaaattcattttcagaacttggcctcccacttgtgttgattgagaggctagagaaggagggtttcaccgttccaaccgaagttcagtctgctgcagttcccaccattctcaacaaccgtgatgtcataattcagtcttacacgggttcggggaagacgttggcttatctgcttcctatactctcggttgttgggccactgaggggggaaattggtgaaggtgacagtgatggcggggagtgtgggaagaagttgggaattgaagcagtgattgttgctccttctagggagcttggaatgcagatagtgagggagtttgagaaggtgctaggaatggataacaagagggcggttcagcagcttgtagggggtgcaaaccgaaccaggcaggaagatgctctcaagaaaaataaacctgcaattgttgttggcacgcctggtaggatagcggagctcagtgcatccgggaaacttcgaactcacagctgtcgatttttggtattagatgaagttgacgaactcttgtcgttcaatttccgggaagacatgcacaggatattggagcatgttgggaggagatcaggtgcagaccaaaactcagattctagaaaggccgagcgacagttaattatggtttctgcaactgtgccattttctgttgtaagggcagctaggagctggggttgtgacccacttcttgtccaagctaagaaagttgccccacttggaactgtctctccctctgagcctatcagtttgtctcagtcttcacccagctcaagccctagcttggctatgccatctccagcagcagtagagagtctacctcctgcattgaaacactattactttgtaacaagggtgcagcacaaagttgatgtgttgagaaggtgtattcatgcactggatgccaaatttgtgatagccttcatgaaccatactaagcagctaaaggatgttgtcttcaagctggaggcccgtgggatgaaagccatggagttacatggggatcttgggaagcttgctaggtcaacaactctgaagaaattcaagaatggtgaggtgagagttctggtgacaaatgaattatcagcaaggggtttggatgtggctgaatgtgatcttgtggttaatctagacttgccgacagattcaattcactatgcacaccgagctggccgaactggtcggcttggtaggaatggtacagtggtaaccatatgtgaagagtcagaagtgtttgttgtgaagaaattgcagaagcagctgggaataccaattgcatcctgtgattttgcagaggggaagctacttgtcagtgaagaagagaaaacagtaagcacttctgaaagatga

SEQ ID NO: 2888 - DNA, 720 bp, Glycine Max
atgccaaggaagaacaagcctaagtttgtaggagtgagacaaagggcatcagggaaatgggcagcagagatcaaagacacatcaaagaagattaggctgtggcttggaacttaccaaactgctgaggaagcagctcgagcttatgatgaagctgcgtgcctccttagaggttcaaacactcgcaccaatttctctactcataaatatggcattgctacaaattctcctatatctctcaaactcagaaacctccttgatcgtaaagccatgtcaaatcaaagtcaaattcaaattcaacgccaatcatcctctacgataagttccactttcgaaggtgctgctgctacttcagctagtccaaatgttagtgccatcaataagatcatggtcatggaaaactactctacttgtagtagtgaaggtaattctatgtttttggttcagaatcaccaagtctctgataacacgtatggactagacacgaatttgatcaactgttcaatgggtatcacaccaaatacatcgcaatttgattgctctagggcactagcccaacaaaggattaacgaattaccaatgccaaaagatggtttgaatgttgaaaggcaattttcagattcggtatatgccaccaatgagtgccatgtggaggatacatttgaatataagtatgaatatgatttcaattatcctctctcacactttttctgcttcacctga

SEQ ID NO: 2889 - DNA, 1638 bp, Glycine Max
atgccaaggaggaacatcatgtcatgtaacatcatgatcaaggcctatcttggaatgggtaatctcgagagtgccaagaacctgtttgatgaaatgcccgacagaaatgttgccacgtggaatgcgatggtcacggggttgaccaagtttgagatgaatgaagaggctttattattgttttcgagaatgaatgagttgagtttcatgccggatgagtactcgttaggtagcgtgctcaggggatgtgcacatttgggagctttgttggcagggcaacaggttcatgcctatgttatgaaatgtgggtttgagtgtaatttggttgttggatgctctttagctcatatgtatatgaaagctggaagcatgcatgatggggagagagttatcaattggatgccagattgtagtttagttgcttggaatacacttatgtctggaaaagctcaaaaagggtacttcgagggagttctggatcaatactgtatgatgaaaatggcgggttttagaccagataagattactttcgtgagtgtgatcagctcatgttcggagttagccatcctttgtcaagggaagcaaattcacgctgaagcagtcaaagcaggagctagttctgaagtttccgtagttagttctttggttagtatgtactctagatgtggatgcttgcaagactctatcaaaacatttctggaatgcaaagagcgagatgttgtgttgtggagctcaatgattgctgcttatgggtttcacggtcaaggagaagaagcaatcaagcttttcaatgagatggaacaagaaaatctgcctggaaatgagatcacattcttgagcttgctgtatgcttgcagtcactgtggattgaaggacaaaggactcggtttgtttgatatgatggtgaaaaagtatggactcaaggccagactacaacattatacttgtctggttgacctactgggcaggtctggttgtttggaggaggcagaggcaatgatacggtccatgcctgtaaaagcagatgcaattatatggaaaactttattatctgcatgtaaaatccacaagaatgctgaaattgcaagaagggttgctgatgaagttcttaggattgatcctcaagactcagcttcatatgttctacttgccaacatctattcttcagctaacagatggcaaaatgtttctgaggtgaggagagccatgaaagacaagatggtgaagaaagaaccaggcataagttgggtagaagtaaagaatcaggttcatcagtttcatatgggtgatgaatgccacccaaaacacgtggagattaatcagtatctggaagaattaacttcagaaatcaagaggcagggctatgtacctgatactagctccgttttgcacgacatggacaacgaggaaaaagaacagatcttgaggcaccatagtgagaaattggcaattgcttttgctttaatgaacaccccagagggagtgccaataagggtgatgaaaaacttgcgggtttgcagtgattgtcatgttgccatcaagtacatatcagagattaaaaaattagaaattattgtgcgagattctagcaggtttcaccatttcaaaaatggcacatgctcttgtggagattattggtag

SEQ ID NO: 2890 - DNA, 1986 bp, Glycine Max; identical to SEQ ID NO: 260

SEQ ID NO: 2891 - DNA, 3492 bp, Glycine Max
atgccaccatccctatcatttagaagctctcccgttagagagccaagatcagacagtcacaagcgtgggcgcagtcttgaaagcggattgccctcaagagagaaagatgatgatcttgctttgttcagtgaaatgcagtccagagaagaagagagttttttgcttcaaccatctgatgacttggaagactcattttcgtcaaagttgagagattttcctgatatcaagcttgggatatccattcctggtcgaggagaaaccagtgaattgcttaatgcagatggtgacgagaatgactatgactggttattgacacctccggacacaccactgtttccttctttagatgatgaaccacgagaattaaatgttgtaagcagaggaaggccaaggagtaaacctatttccatatcaagatcatctacgacagagagaagttacaaaagcagaaggggtagtgcaagtccaggtcgtttaagttcatcccctcattctgggaataatacattgcaatcgaggggaatgtcttcatcaacaccaaattctagtccaactcaagttttacgacatgctactccaacaagaaggtcatctcctccaactaagcccacgacacctgctcctagaccttccactcctactcctcggcgaatcagcactggctccagtagtcctgcactctcattggggattaggggaacttcccctgttaagacaagccgtggaaactctgcttcaccaaagataagatggcagactaatattcctgttttctcttctgaagctcctctcaatctccgtacctctttggctgatcaaccagcatcatatgtgagaggttcatctccagcatccaaaaatagtagggattctacttctaaatttggtaggcaatcaatgtctcccactccttccaggagcagcagttatattcatagtcatgatcgagcccaatctagttcacacagcaaaggttctgttgtatcttcaagtgatgatgatctggactctcttcagtccatcccagtgggtagtctagatcgatttggttcaagaagggatggttcattttcaaacagcaaatctccttcaatttccaagaagtcagccaagatggtgtccccaagttctgctcctaaaagatcttttgattctgctatccggcaaatggatagaaaaagtcctcagaacatgttcaggcctctcttatctagtgttccaagtacaaccttatatgtcagaaaagcaaattctgcacaacattccctggtatctaggaactcctctgtcacaacaagtagcaatgcaatctgtgatcatggtacaaattttgtgccagatgctgaagggagtgaccacaatcaagatgatatggcttgtgaatctaagatattatacactgatattcgtgaagaagtattttcctttgataaaattggtggattaaatgcaaacattgggcatgagatcaatgatgaatcagttgatgtcctgcacaacaaaactagaggccctgtgattgctttagaccctactgaatctgaagcttctttttatcatggtattgacaaagaattcaatgaaagcttagaaacttcccatgccataggggacatttctgaaactggtggttttgagaatacaacaatttgttccaattgtggttgccctcttgaggccacagatcaaactgagaagaatcttaggctgtgtccaaaatgtagcaggaaaaccacattgttgagacatgtaatcccggaggcaaatttggctgtttccagtgaaaattcagtgaattccacagacattcttgcagaagatagaccatcagccaaaacagaccaactaaccgttgtgtctgaactgcctcaagagactgatgtgggtaacatgaggtttccccttggtgaaccagatgctgtggaaattcaaacttttcccagtgaatttattcaggaccactcgcaacaaaattctctctcgagttcactggtggagggaagtaggcagatgcctgccaatcagcttgaagtggaccagtcaggggttgatgacaagaagcccgataatcattctagcagtcagcagttgtatctttccaacgacagctcaaatttgaaagtggacctcttggaaggcactggcatttctgtactactgaaaaggtcaagcagtagcaaaggacatgtaattcagggcaggacttttactgccacgacgctatcttatgatgatctgtcttttgcaagaagcagcattaacagtattagaagctcaactggacgtagcagttattctaccacttcatctgccgatttcagctcagcaagacattctgattttcgtgtccaaaggcagtcaagtggcaggaaattggatgtagactatggatatgatgttaggatcaggcctccaagccctggtttatctttttctggaatgtcaaaccattcttaccatggattagaatgcagcatcctggaagagataccccaagatctacgagaaatgcaagcttcagaaaatgcagtaacagatgtaattgattcttcctctatgggtttgattgttgtcagggaagataatcttgaatatcatgattgtggtagaacaactgatgcctgtagctcaggattagtaagccaagctactggtgttcagcatgatgacaattcagtgtcagcatttccaaatcatgggagttttatttcaaatgatagtattgaagaccagccgaataatgtaagcagtgtctcaaatacggaaacaacagttaaggatccagagtcatcctttgatgagaaacatgatatggagaactcttgtgttgatggactggatgctttggtaactatcaacacttctacaattgaagaatcagaaatagaaggggaaaactgttgtcagaaggatactggtgtggtggatgttgatccatcgctggtatcaaagtgccccattgcagactttcaggaacattctgttccaaattcttccagtgattgtcttgcagcttctgtttccgagctccatgcctctgagtactcccttggcatagagggatccacagttacggtggagtgtcaagatggaggaaatgctagaaacctgacacttgaagaggcaacaaatactatacttttttgcagctctatcatccatgatcttgcatatcaggctgcaacgatagcaatggaaaaggaacactcggaaccattggaaggttctgagccaacggtgactatattgacaaaacccaattccgatataaaggattctcgcagccgaactgctggcaagcgtgctatgaaaccccagaaggcaacaaggccaaagatggtggaagttgatgtaaaatccccttccaagattgagaatgacgaaaatattgacgagtctttgacacgcaatgttgggcttcctaacaaaatagacaacgtgaagccccttccaaataagcttgaatcaaagtgtaattgcgtcataatgtga

SEQ ID NO: 2892 - DNA, 1935 bp, Glycine Max
atgccactcaagtctcctactgaagatgactatctgggcatctacagcatcatgttttggactcttactctcattggggttgtcaagtacgccaacgttgccattagagctgatgaccacggtgaaggtgggacttttgccttgtactcattgctttgtaggcatgtcaatattgggatcctgccctccaagcatgttggtttgaacacaactaaggacgtccaaaagagtacttcgcttgccagattcttccaaacaagcgtggttgctcgtaggctcttgctctttgttgctatgttgggtacttgcatgcttattggtgatggtatacttacgcctgcaatttcagtgttgtcagcaatggatggactaagagcaccttttccttcagttagcaaaacgctagtggaaacactctctgcaattgttttgatcgttctgttcttgttgcaaaagtttggcacatcccgtgttagtttcctcttttctccaataatgggtgcatggacgctgagtaccccacttgtaggaatttacagcatcatacaccattatcctagcatatttaaggctttatctccccactatatattccgtttcttttggagaaatggaaaatctggctggcttttacttggtggtactgtcctttgcattacaggttctgaggcaatgtttgctgatcttggtcatttcaatcagaagtccattcagatagcttttctattcacaatctacccatctttagttctgacttatgcgggacagacagcatacctgatcaagcatcccaatgatcatgatgacggcttctacaaatttataccaacttcagtttactggcctatctttgtcattgccacttctgctgcagttgttgctagccagtccttaatatcagctaccttttctgtaatcaagcaatctgtagtgctggattattttcctcgtgttaaggttgtccacacatctaataacaaagaaggagaggtttactcccctgaagtgaactacatcctgatgatcctttgtgttgctgtgatacttatttttggagatggaaaagatattggaaatgcttttggtgttgttgtgagcatagttatgcttatcaccactatattactcacattggtgatgatcatgatatggaggactcctgctatactggttgccctatactttgttgtattttttgtgatggaaggggtttatgtcagtgccgttttcactaaatttgctgaaggtggatggattccttttgccatatcacttatccttgctttcatcatgtttggttggttttatggtagacaaagaaagattgattatgagttaacccacaagataacctttgagagacttgaagagcttttagctgaccgcagtgttcaaagggttcctgggctatgcttcttttataccaacattcaagaaggcctaactcctattcttggacactacataaagaacatgaaatcccttcacaaggtcacaatattcactactcttagatatttgttagtccccaaggttgctccacatgagaggattgtcatcaagaaatcgaatctcgaaggtgtatattgctgtgtgattcagtatggctatgcagatgctttaaatttagaaggagatcattttgttaatcaagtcatcactagtttgacacaacatatacagaactctcctgacaagctttcatctgattctcgagagattgaagagacttcatacttagaagaggcaaggtgtgcaggggtagttcatgttcgtggaaagacaaaattttacattggcctgaactgtggctggtttgataaatttgtgcttagattttatgaagtcatgcacaataactgtagatctgccttgcctgctctaggggttccaccacaacaacggattgaagttggaatgctatacgaggcttga

SEQ ID NO: 2893 - DNA, 2646 bp, Glycine Max; identical to SEQ ID NO: 261

SEQ ID NO: 2894 - DNA, 657 bp, Glycine Max
atgccaggtcttaccatcggagacactattcctgatcttcaagttgaaactaaccaaggcaaaatcaagcttcatcagttctgtgctgatggctggaccatccttttctctcacccaggtgatttcaccccggtttgtaccactgagcttggtaagatggctcagtatgctaaggagttttatcaacgaggagtgaagctcttaggtttatcttgtgatgatgtgcaatcccacaatgagtggatcaaagacattgaagcctacactccaggtgcgaaagtgaattatccaataattgctgatccgaagagagaaatcatcaagcaactcaacatggttgaccctgatgagaaagactccactggcaacctaccctcaagggctcttcatattgttggcccagatttgaagatcaagctgagttttctgtaccctgccactactgggaggaacatggatgaagtgctgagggtgatagagtcattgcagaaggcctcaaagttcaaggttgctaccccagcaaactggaagccaggggaccctgttgtcattacccctgatgtcaccaatgagcaagccaaggaaatgttccctcaagggttcgagagtgtgaaactcccatcaaagaaggaatatttgcgcttaactaaagtttga

SEQ ID NO: 2895 - DNA, 1833 bp, Glycine Max; identical to SEQ ID NO: 262

SEQ ID NO: 2896 - DNA, 321 bp, Glycine Max
atgccatcatctcattcagcaactgtcactgctcttgcagctgctattggattgcaagaaggctttggaggacctctttttgccactgccttggtttttgcttgtattgtgatgtatgatgctactggtgtaagattgcaagcaggacgccaagcagaggttttaaaccaaattgtgtatgaacttcctgctgagcatcctctggccgaaagcagaccacttcgcgaacttcttgggcacaccccccctcaggtcattgtcggtgggatacttggacttttaacagcaattggccttttaagacctgtgaccaagaattga

SEQ ID NO: 2897 - DNA, 144 bp, Glycine Max; identical to SEQ ID NO: 263

SEQ ID NO: 2898 - DNA, 498 bp, Glycine Max; identical to SEQ ID NO: 264

SEQ ID NO: 2899 - DNA, 498 bp, Glycine Max; identical to SEQ ID NO: 264

SEQ ID NO: 2900 - DNA, 2058 bp, Glycine Max; identical to SEQ ID NO: 266

SEQ ID NO: 2901 - DNA, 1317 bp, Glycine Max
atgcccctctctttttcccttgcaagcgtcggcagtttcttttgtaggattgtgaggaacaaaactactcataaggaacacccaagaggagggaatttgaagggcccctctctcactcaaccctgtcaaaggtgtcaagcacatttttttgtttgtgtgtgtagcaaagggtggtggtgtggtgcttgttgtggttggtggtggagtgcgcaggataagcggcaaagtaagagtcctgatggagatgttattgattgcatccatgttacacaccagccagcttttgatcaccctgacctcaaaaatcacaagattcagatgaaaccaaatttccatccagaagggcatccttttggagaaagcaaagtctcttcaaattcaaagcctattactcagctgtggcaccaaaatgggaggtgccctgaaggaacaattccggtccgaaggacgaaaaaggatgacatattaagaacaagctctgttcagcattttggaaagaagaagcaaagtagcttccctcagccaaaacctgcaaaacctctacctgacatcatcagtcagagtggccaccagcatgccatagtgtatgtggagggagataagtattatggagccaaggcaaccataaacgtttgggacccaaaaattcaacaacccaatgaatttagcctttctcaaatgtggattttgggtggctcttttggtcaagatctcaacagcattgaagcaggttggcaggtcagccctgatttgtatggagacaacaacactagactcttcacttattggacaagtgatgcatatcaagctactggttgttataatctcctttgctctggctttattcaaattaacagtgatatagccctgggagcaagcatctccccactttctaagtatagctcttcccaatatgatatcagcatcctggtctggaaggaccccaaagagggtaactggtggatgcagtttggtaatgatcatgttatgggatactggccggctcctctattctcgtacctctccgacagtgcgtcaatgattgagtgggggggagaggtcgtgaactccgagtccgacggccaacacacctcgactcaaatggggagtggccatttccctgaggaaggttttggcaaggctagttacttcaagaacattcagattgttgatggtgacaacaagcttagagctccaaaagaccttggcacttacactgagcaagatagctgctacaatgttcaaactggtagtgctggagattggggtaactacttctactatggtggtcctggtagaaatccaaattgcccttga

SEQ ID NO: 2902 - DNA, 306 bp, Glycine Max; identical to SEQ ID NO: 267

SEQ ID NO: 2903 - DNA, 490 bp, Glycine Max; identical to SEQ ID NO: 268

SEQ ID NO: 2904 - DNA, 1632 bp, Glycine Max
atgccgaatactttgactacatgttgtttagcaacagaggccctgaaaaaacttcgtgaaaggaaagaagcatatgacatagtgatcagcgatgtgaacatgcctgacatggatggtttcaaacttctggagcaagtaggacttgagatggatcttcctgttatcatgatgtctgttgatggagaaacaagcagggtgatgaaaggtgttcaacatggagcatgtgattatctccttaagcctataaggatgaaagaactgcgaaacatatggcaacatgtctttagaaaaaggatgcatgaggcaagagattttgaaagccatgagggttttgactttgagggcattcacttaatgagaaatggatcagatcactctgatgatggtaacctgtttgctgtagaagaaactacgtcaattaagaaaagaaaagatgcagataacaaacatgatgacaaagaatttggagatcattttcccacaaagaaagctagagtagtttggtctgtggatcttcatcagaagtttgtcaaagcagtgaatcaaatcggatttgataaagttggtcccaagaaaattctagatctgatgaatgttccatggttgactagagaaaatgttgctagtcacttgcagaaatacaggctctacttgagtaggttgcaaaaggaaaatgatcagaaatcttcatcaagtggaataaagcactcggattcaccttcgaaagatctaggaagttttagttttctgaacactgcaaacaagcaacaaaatgatattgccactgacagcttcagttattcagatggaactttactaattcagatggatgctacaagttatgaaggtgatctcaagggaattgtgtcagagcctacaacagaaaaaagaagagcttccactagtgaaattccggatccaaaggtacaaaaaagttcgcagaagagcctcaacaaaccttttacatctgtagagtcatcagaagcaaaccatgcagtctttgattgcaccataccaacagaatactcttggagtgagtttccaaaaggtccactcaaagaagaacagaagacacctgttcaattagaggatagcctctgccagttgccattgcatggtacacagcatcacattcagattgatcaatcacaatcaattgcctcaattaattccaatccctctataacagaagaagaggttgctgccaaattagagaccaaacctttgtatgctggttacgagagtgattatgtgaatcctgtgagttcaataggatctgcagttgaagcctttcgtagtcagtccaaaagccttatggtgagtgatcaatcttcagagcccactttcacctcgaatttgagcttgaagactcagggattcaatctagattgcatttctgatctggatttttaccaaaggaacctattattgggtggtgaggtagcttctgcacctttggatgaggacctgaatttctttttgctacaaagtgaatgctacaacatgaattttggactgcagaatatagatatgtcagagtattatgatccaaggcttactgctgaagtccctagccacttttatgattcagcagattattcatcggtagatcaaagtctattcattgcatga

SEQ ID NO: 2905 - DNA, 1701 bp, Glycine Max
atgccggcttggtggaatagaaagtggagcaagagcaaggaggagcaggagcagccggaggaggaggatgaggaggaagagccacgtgccgcttttcagctgaatttcatgagcggtgagcgggacaagaacaagggtaggagttgtagtaagaagaagaccaagagcttcgacgacaaggtcaaaggggttccgttaccacttccctcgcatagtctcagcgatccaattcaatcatttggatctgtttcggtgtccggtggttccagcatcagctcctccacctcctatgacgatcatccaatttcgcctcccaacaccaacagaggacgagaggaggtgaggttcaatgtgaggtcaaaaagtccgggtcctgggtcaagaggacctaccagtcctacctcaccgcttcatcaaaggttgcatgctttgagccttgactctcccacggggagtgagtgtcatccattacctcttccacctggctctccaactagtccttcttctgtgctttccaacgctagagcaaatggacatttggaaaatgctaccagcaatgtgtccaaatggagaaaaggaaagcttctaggacggggaacatttgggcatgtttatctgggattcaatagtgaaaatggacaaatgtgtgcaataaaagaagtcaaggttgtctttgatgatcacacatcgaaagagtgcctcaaacaacttaaccaggagataaatttgctaaatcagctttcacacccaaatattgttcaatactatgggagtgaactggtagaagaatcactttctgtatatttggaatatgtctctggtggttctatccataaattacttcaggagtatggtccatttaaggagcctgttattcaaaattataccaggcagattgtctctggacttgcttatctgcatggaagaaatacagtacacagggatattaaaggggcgaacatactagttgatcctaatggtgaaatcaaactggcagactttggaatggctaaacatataaattcttctgcctcgatgctttcattcaaaggaagtccatactggatggcacctgaggttgtaatgaatacaaatggctatagtcttccagttgatatatggagcttggggtgcacaattattgaaatggcaacatcaaaacctccctggaatcagtatgaaggggtagctgccatatttaaaattgggaacagcaaagatatgcctgaaatccccgagcatctttcgaatgatgcaaaaaaattcatcaagctatgcttacaaagagacccattagctcgcccgacagcccaaaagttactagaccaccccttcattcgagatcaatcagcaacaaaagctgcaaatgtcagcataaccagagatgctttcccttgcatgtttgatggaagccggacaccgcctgtgttagagtcccattccaaccgaacaagcataacttctcttgatggagattatgcatcaaagccagctcttgcagcaccacgtgcattaaggagttcaagagataacacaagaatcatcacatctttaccagtatctccctcttcaagtccattgcgaagatcctcatatccaatgacatcaaatgccacgtttgctcttgatccttggcatgaaacatctcgatacagagccaatacaccacctggtggatctccaagaatgagactaatttaa

SEQ ID NO: 2906 - DNA, 1791 bp, Glycine Max
atgccggcttggtggaatagaaagtggagcaagagcaaggaggagcaggagcagccggaggaggaggatgaggaggaagagccacgtgccgcttttcagctgaatttcatgagcggtgagcgggacaagaacaagggtaggagttgtagtaagaagaagaccaagagcttcgacgacaaggtcaaaggggttccgttaccacttccctcgcatagtctcagcgatccaattcaatcatttggatctgtttcggtgtccggtggttccagcatcagctcctccacctcctatgacgatcatccaatttcgcctcccaacaccaacagaggacgagaggaggtgaggttcaatgtgaggtcaaaaagtccgggtcctgggtcaagaggacctaccagtcctacctcaccgcttcatcaaaggttgcatgctttgagccttgactctcccacggggagtgagtgtcatccattacctcttccacctggctctccaactagtccttcttctgtgctttccaacgctagagcaaatggacatttggaaaatgctaccagcaatgtgtccaaatggagaaaaggaaagcttctaggacggggaacatttgggcatgtttatctgggattcaatagtgaaaatggacaaatgtgtgcaataaaagaagtcaaggttgtctttgatgatcacacatcgaaagagtgcctcaaacaacttaaccaggagataaatttgctaaatcagctttcacacccaaatattgttcaatactatgggagtgaactggtagaagaatcactttctgtatatttggaatatgtctctggtggttctatccataaattacttcaggagtatggtccatttaaggagcctgttattcaaaattataccaggcagattgtctctggacttgcttatctgcatggaagaaatacagtacacagggatattaaaggggcgaacatactagttgatcctaatggtgaaatcaaactggcagactttggaatggctaaacatataaattcttctgcctcgatgctttcattcaaaggaagtccatactggatggcacctgaggttgtaatgaatacaaatggctatagtcttccagttgatatatggagcttggggtgcacaattattgaaatggcaacatcaaaacctccctggaatcagtatgaaggggtagctgccatatttaaaattgggaacagcaaagatatgcctgaaatccccgagcatctttcgaatgatgcaaaaaaattcatcaagctatgcttacaaagagacccattagctcgcccgacagcccaaaagttactagaccaccccttcattcgagatcaatcagcaacaaaagctgcaaatgtcagcataaccagagatgctttcccttgcatgtttgatggaagccggacaccgcctgtgttagagtcccattccaaccgaacaagcataacttctcttgatggagattatgcatcaaagccagctcttgcagcaccacgtgcattaaggagttcaagagataacacaagaatcatcacatctttaccagtatctccctcttcaagtccattgcgaaggtatgagccaatgcatcagagctgttttttttctcctcctcatccagcttacaccacaatgggacaaagtagttacactttgaatgacagatcctcatatccaatgacatcaaatgccacgtttgctcttgatccttggcatgaaacatctcgatacagagccaatacaccacctggtggatctccaagaatgagactaatttaa

SEQ ID NO: 2907 - DNA, 1506 bp, Glycine Max
atgccggcttggtggaatagaaagtggagcaagagcaaggaggagcaggagcagccggaggaggaggatgaggaggaagagccacgtgccgcttttcagctgaatttcatgagcggtgagcgggacaagaacaagggtaggagttgtagtaagaagaagaccaagagcttcgacgacaaggtcaaaggggttccgttaccacttccctcgcatagtctcagcgatccaattcaatcatttggatctgtttcggtgtccggtggttccagcatcagctcctccacctcctatgacgatcatccaatttcgcctcccaacaccaacagaggacgagaggaggtgaggttcaatgtgaggtcaaaaagtccgggtcctgggtcaagaggacctaccagtcctacctcaccgcttcatcaaaggttgcatgctttgagccttgactctcccacggggagtgagtgtcatccattacctcttccacctggctctccaactagtccttcttctgtgctttccaacgctagagcaaatggacatttggaaaatgctaccagcaatgtgtccaaatggagaaaaggaaagcttctaggacggggaacatttgggcatgtttatctgggattcaatagtgaaaatggacaaatgtgtgcaataaaagaagtcaaggttgtctttgatgatcacacatcgaaagagtgcctcaaacaacttaaccaggagataaatttgctaaatcagctttcacacccaaatattgttcaatactatgggagtgaactggtagaagaatcactttctgtatatttggaatatgtctctggtggttctatccataaattacttcaggagtatggtccatttaaggagcctgttattcaaaattataccaggcagattgtctctggacttgcttatctgcatggaagaaatacagtacacagggatattaaaggggcgaacatactagttgatcctaatggtgaaatcaaactggcagactttggaatggctaaacatataaattcttctgcctcgatgctttcattcaaaggaagtccatactggatggcacctgaggttgtaatgaatacaaatggctatagtcttccagttgatatatggagcttggggtgcacaattattgaaatggcaacatcaaaacctccctggaatcagtatgaaggggtagctgccatatttaaaattgggaacagcaaagatatgcctgaaatccccgagcatctttcgaatgatgcaaaaaaattcatcaagctatgcttacaaagagacccattagctcgcccgacagcccaaaagttactagaccaccccttcattcgagatcaatcagcaacaaaagctgcaaatgtcagcataaccagagatgctttcccttgcatgtttgatggaagccggacaccggtatatattcttagatatatatttattttctttgaaaagtcatgttcttacttgctcgtacctaacatgctgcaattgtcctga

SEQ ID NO: 2908 - DNA, 435 bp, Glycine Max
atgccggctttaatgagtctcgagaggagaattgtgctccgtgctttgggagctgagctgcatctcactgatcctgctatgggcttcagaagtagtcttcaaaaggctgaggagctactgagggagacatgtgatgcttttatgtctcatcaatttgaaaatcctgcaaacccaaagattcactatgaaaccactggccctgagatatggagagattctggagagaaagttgatgcccttgtagcaggtataggaactggcggtacaataacaggtgcagggaaattcctcaaggagagaaattcaaaaatcaaggtctatggagtggaaccagttgaaagtgcagtcttgagtggaggacagccaggagggcatctgattcagggaattggtgctggtattgttcctgctgtgctggatgttaaatctgcttga

SEQ ID NO: 2909 - DNA, 2112 bp, Glycine Max
atgccggtggcgaggcgagagacgtgcgatggaagagtgattgctcatgtagacatggattgcttctatgttcaagtggaacagagaaagcaaccaaatttaagaggcttgccctctgcagtcatacagtacaactcctacaaaggtggagccctcattgctgttagctatgaggctcgccgatgtggcgtcaaacgttcaatgcgaggggatgaagccaaggaggcatgcccgcaaattcaactggtccaagtcccggtggcgcgtggtaaggctgatctcaactcgtacaggaatgcgggttcagaggttgtttcggttctttcacagaagggccgttgcgaaagggcttcgattgatgaggtatatcttgatctaacccatgctgctgaaaccatgttgatggaaactcctctggatagcatgcaagactttgaggatgaagttctcaagtcacatgttttgggtttggaaattaaggatggaagtgacgccaaagatgaagttaggaagtggctttgcaggagtgatgctagttaccaagataagctattagcttgtggggctctcattgtgtgtgacctcaggatgaaggtgctgaaagagacagaattcacatgctctgctggtattgctcataataagatgctggctaaacttgcaagtgctatgaacaaacctgcacaacaaacagttgtgccacaatcatctgttgaagggttgcttgcttctttgccaataaagaaaatgaaacaccttgggggaaagctggggagttccttacaaagtgatcttggtgtcaacactgttggtgatctgcttcagttttcagaggagaagttacaacagtggtatgggatcaatactggtacttggttgtggaatattgctagaggaatcagtggggaagaagttgaggggcgactacttccaaagagccatggttctggcaagacatttcctgggcctcaggctttgaagaccgttgattctgttcaacactggcttaatcaattgtgtgaagagctgaacgaacgccttcactctgaccttgatcaaaacaaacggattgcacagacactgactctacatgctagagcatataagacaggggattcagattctcatagaaagtttccttctaaatcttgtcctttaaggtatgggactagaaagattcaagaggatgccctaattctatttcaagctgggttacgtgattttttgggcttctacaactgtaaggctcatggaaacgaaaataacaactggggagtaacatcactttctgtttctgcaagtaaacttgtgtccataccatctgggacacattcaattgttaaatactttggagggtcatttccatccagttctacatcaaatcaatcgctggatgttgtgattgatgaagctgctccatcctcgccttcaggaagtggaaattgttcaggattggttcccaatgaatttgagcttgaatatcctgaagacacaggaatgaaagattcaaaggcttgtttggatcaacaggatccgttgtgtcatttatcctgtaaagcagatggcttgactgaagaatcctccctcgtgtcaccctcaggaagcgaagacagaatcctgcacaatgagccacatagagatttacctgcaacagatcttaggcgtgtttcgaatatctctagtttgaaagcagttgggaagaaaaagacagcaggaaagaagcttcaagggaattgttcaattgtacatttcttcaataattaccataattcccagtcttcattggagcagaagaatgtcaaaatatcatcatcacttggatctcactctgctgataatagtcattcaacttgtattcaagttgagatgcctgctgagcaccctcatgaagagtttgatacaaacaagagtcgatgtagcgtaggtaatatgccacaaggaaggcaagattggagttataacatcaatgagattgacccctctatcatcaatgaattaccaccagaaattcagcaagagtttcaaatctggcttaggccgcataagcggcctaatgtggctaaacgaggttctagtattactcactatttctcacctgacaaaagtagataa

SEQ ID NO: 2910 - DNA, 1209 bp, Glycine Max
atgcctaaagttagaagattgaagtccctgtctactgattgtaatagaccgtatccttacccatccaactccaaaaacattgagctgcataaacctatgaatttgttggaatcggctgatgaaatgaaagaatgggaggaagctagatgtcctatttgcatggaaccccctcacaatggtgttcttttgaaatgttcttcctatgagaagggttgtcttccttacatgtgcaataccagttaccgccactccaactgccttgaccagttttgtaagtcctttgcttctcatctctcatcagaagtactgcaagaaattcctgtcacaggcagagtctcacatagtagagaaattcagtcagagtcttggcaccctgctcaatgtgggagccagttacaaccaaagctcatttgccctctttgccgtggagaaatatatggatatatggttttggagcctgctcgaaggtatatgaattctaaactaaggagttgttcttccgaaacatgtgaattccaggggacatatccagaactcaggaagcatgctaggtctgagcatccttctgttcgaccatcagaggtggatccctcgcgacaatgtgattggttaaggatggaacaagaaaggggtttgggagatctttttagctcaatccatgcaagttctggtgcagattacaatagagataccattttgactgggggtcttgctgacttgatgtcctcattcttgtatgaaatatttatctctattgaagatgttaaccgaatggctagtttgttgactaattcgagacacagagttccattatatgacagaaggtctggaacaacaaacagggtatcaaatgatacacagacaagtcaatcagctagatggagatccaatttaccttcagtgcatcaactggagagaattgccagaagtagagtgagaagcaattttccgtatttatcatcccgtgatcttgaggcagaggcaaatcgtacggctagatggagaacaaatttatcatctttaagaacgcctcgcaatgagcatcagtatagagacctcagtgcagaggtcacatcttcaacaaggatgcctcgggcctcacaaggtactcagactaatccccagagcaacatttcttcatctggaaggttccctggtcgtcaattacgctggcgtgatcaaagctggtcgacaaacaaccaccaatga

SEQ ID NO: 2911 - DNA, 1209 bp, Glycine Max; identical to SEQ ID NO: 2910

SEQ ID NO: 2912 - DNA, 210 bp, Glycine Max
atgcctaagcagatccacgagattaaggattttcttctgacggcgcggaggaaggatgcgaggtcggtgaaaatcaagaggagcagggatgtcgttaagtttaaggttcgatgctccaagtacttgtacacgctttgtgtctttgaccctgagaaagccgataagttgaagcaatctcttcctcccggtttgagtgttcaagacctgtag

SEQ ID NO: 2913 - DNA, 1167 bp, Glycine Max
atgcctagttttgtggctgaaaagaagatatttgtagagccaaatatgtgttttaccaatttggccaaccatgatagaccaactcttacaaaaaacaatcattatgtgaggtctgaggctctggatgatgatgatgatggtactagccccatcctacctgggctgcctgatgatgtttcaaaacactgccttgcactcgtgcctcgttcgaacttcccagccatgggtggtgtctgcaagagatggaggggctttattcgaagcaaagaatttataaccgtgcgaaaattggctgggatgcatgaggaatggctctatatcttgacagcaggcagtgaaggaaaagggagccattgggaggtcatggattgtcttgggcataatcgccgatctcttccaccaatgcctggtccagcaaaggctggctttggggtagtagttcttaatggaaagctccttgttatggctggttattcatccattgatgggactgcttctgtctcagcagaggtttaccaatatgattcttgcctcaacagctggagcagattgtcaagcatgaacgtggctcggtatgactttgcttgtgctgaagtcgacggcttggtttatgccgttggaggctatggcgcaaccggtgacagtctctcaagtgcagaggtgtatgatctggataccgacaagtggacgccaatagagagtctccgtcgcccgagatggggttgctttgcctgtggattcgaggggaagctctatgtcatgggtggaaggtcaagcttcacaattggaaactccaagtttgttgatgtctacaaccctgagaagcacgggtggtgtgagatgaaaaatgggtgtgtcatggtcactgcttatgcagtgctggaaaagaagttgttctgcatggagtggaagaaccagcggaagttggcaatattcaatccagaggacaattcatggaaaatggtaccagtccctttgacagggagttcaagcattggttttcggttcgggatattggatggtaagttgttgcttttctcactggaggaagagccttcatataagactttgttgtatgatccaaatgcagcaccaggatctgagtggcacacctctgatataagaccatctggtttgtgtttatgcagtgtaactattaaggcctga

SEQ ID NO: 2914 - DNA, 1167 bp, Glycine Max; identical to SEQ ID NO: 2913

SEQ ID NO: 2915 - DNA, 1167 bp, Glycine Max; identical to SEQ ID NO: 2913

SEQ ID NO: 2916 - DNA, 1026 bp, Glycine Max
atgcctagttttgtggctgaaaagaagatatttgtagagccaaatatgtgttttaccaatttggccaaccatgatagaccaactcttacaaaaaacaatcattatgtgaggtctgaggctctggatgatgatgatgatggtactagccccatcctacctgggctgcctgatgatgtttcaaaacactgccttgcactcgtgcctcgttcgaacttcccagccatgggtggtgtctgcaagagatggaggggctttattcgaagcaaagaatttataaccgtgcgaaaattggctgggatgcatgaggaatggctctatatcttgacagcaggcagtgaaggaaaagggagccattgggaggtcatggattgtcttgggcataatcgccgatctcttccaccaatgcctggtccagcaaaggctggctttggggtagtagttcttaatggaaagctccttgttatggctggttattcatccattgatgggactgcttctgtctcagcagaggtttaccaatatgattcttgcctcaacagctggagcagattgtcaagcatgaacgtggctcggtatgactttgcttgtgctgaagtcgacggcttggtttatgccgttggaggctatggcgcaaccggtgacagtctctcaagtgcagaggtgtatgatctggataccgacaagtggacgccaatagagagtctccgtcgcccgagatggggttgctttgcctgtggattcgaggggaagctctatgtcatgggtggaaggtcaagcttcacaattggaaactccaagtttgttgatgtctacaaccctgagaagcacgggtggtgtgagatgaaaaatgggtgtgtcatggtcactgcttatgcagtgctggaaaagaagttgttctgcatggagtggaagaaccagcggaagttggcaatattcaatccagaggacaattcatggaaaatggtaccagtccctttgacagggagttcaagcattggttttcggttcgggatattggatgtgtaa

SEQ ID NO: 2917 - DNA, 828 bp, Glycine Max; identical to SEQ ID NO: 269

SEQ ID NO: 2918 - DNA, 618 bp, Glycine Max; identical to SEQ ID NO: 270

SEQ ID NO: 2919 - DNA, 2031 bp, Glycine Max
atgcctccttcacaattccctcttcgttgggagagcacaggagaccgatggtggtatgcatctccaattgattatgctgctgcaaatggcctctatgatctggtcactgagcttctccaccttgacaccaacctcctcattaagctcacttcccttcgtcgaattcgccgcctagaagccgtgtgggacaacgagtccaagtttgaggatgttgccaggtgccggtccaaggttgcaaggaatcttatgattgagtgtgagacaggaagagggcataagcataactctctcatccttgcaggctatggtggatggcttctctacactgctgcttcggccggggatgtggactttgttcttgagttgttggggagagaccctcttttggtgtttggtgagggagagtatggtgtcactgatatgttttatgctgcagccaggggaaagaactgtgaggtctttaagctgctgcttcgttctgctctttcaagaaaggagtgccttggtggaagtgaagcagaattggaagagaagttggatgagggttctaaggttttcaagagggatgtgatgaatagggccatccatgctgctgccaggggagggaattgggaaatactgaagcagattctagcaagtgtttctgtttctcaggttttgtcttatagagattcacaaggatgtactgtcttgcatgcagcagctgcaagaggccaagttgaggtggtgagaaatctaattgaatcctatgatatcatcaactcagctaatgctcaaggcaatacagcattacatgtggcctcttacagaggttacttacccgtggtagagattctgattggagcatctcactcgttagcaacgttaaccaatcactatggagatacttttcttcacatggcagtggttggtttcagaagccctggtttctgtagactggacaagcacactgagctcatgaagcaactgacaagtgaaaaaattgtgaaaatgaaggatatcatcaatgtcaggaacaatgatggaagaacagctcttcatgttgctgtggttcataatatccaatttgatgtagtggaattactgatgtctgttccatcaattgatttgaacatttgcgatgctgatgggatgacacctttggatcatcttagacaaaaatcacgatcagtgtcttctgaaatcttaatcaagcaattaatttcagctggagggatctctaattatcaggactatgtgacaagaaatgcccttgttaagcatcttaggactcatggtattggaggcagtcctggaacatcatttagaataccagattctgagatattgttgtacacaggcattgagaattcatgtgatgacaattatgatcaggcaagtgtagaatcaaattcatggtcaagtgaaataaacaattatgactcggccaattcgccatgtaacagcaagtctagttctgtcaattatggggcaaggcacctaaagtttctgctccaaagttctagaagaagagacacaaaagaggcagcctcagatttagaagatgatgtttctgtgaattctttcagctcaaggaacaacttggaagactttccaattccattgaggcaaagatactcaaaaatgtgttctcttccaaacaacaaaagaacactatctataaggacttatcttccaagtcctacagccaaaaaatattttcatgcaggtctaacgcaaggcgtgattaaggtaaagccacaagtgcctctacctgttcattcaacatctaatctttttcaaaaactatctatctcttctaattctacgaataataagcaaaaacgtgttgatataatgggaccctcttgctccaatcgaccaatggatgggggtggcaccctacagttgaactttaagcagggcactttcaataggagattgatgaaccggtacttttcttttggagcacatggccaggctttggaagatgcaaatagctgcacaatgtcaaattgcagttctaagcattttagttctttagttgcataa

SEQ ID NO: 2920 - DNA, 567 bp, Glycine Max
atgcctcgccatgatgataaatatagtaatacccgcctcgacgttggacacttgtcttcgatgactcgttcccgtgacctggagcgtgtcttcagcagatatggaagagttcaaggtgtggatatgaagaattttttcgcctttgttgactttggcgatcctcgagatgctgatgatgctagatataacttggatggtcgtgaagttgaaggaaggcacgttactgtggaatttgccaaggggggtcctcgtggttcctgggaatcctcaggtcagggtcagggtccacctactggacctggacgatgttttgactgtggcttgatggtcattgggcccgagattgcaaaactggggatgggaagaacaagtaactgtaagaacagtcccaaaaagttgaggtcacattctgctcatcatggcagaagaagggatcgaagctacagccgagaccgcagctacaggttggattctaatattaatgggcatagccgtagccttagggatgatgacaagagccccattgatgaagatgatgacaaccaccgtcgctcactgtcaccttga

SEQ ID NO: 2921 - DNA, 426 bp, Glycine Max
atgcctcgccgtagctccggtggaagatctgcccgtcctgctcctcgggcagctcctcgtcctgctccagttcaccatgctcctcctccagcccctgctcagagtggtggtggatctatgcttggtggcattggttcaaccatagctcaaggtatggcttttggcaccggaagtgcagtggcacacagggctgtggatgcagtcatgggtcctcgtaccattcaacatgaaacagttgttacagaggctgctgctgctgcccctgcacccactgcaaatacttttggtggcgatgcatgcagcattcatacaaaggcattccaggattgcctgaacggctatgggaatgacattagcaagtgccagttttacatggatatgcttgcagaatgcagaaagaactctggagccacgttgagcatgtaa

SEQ ID NO: 2922 - DNA, 2880 bp, Glycine Max
atgcctctggtgaggttgcaggtgaggaatgagttcggtttggggcagcctgagttgtacagaaagacaaacagagaggaccctaaagctgtgttggatggtgtggctgtggctggtcttgtcgggatcttgaggcaacttggtgatcttgctgatttcgcagcagaggtttttcatggtctgcaagagcaagtaatgacaacagcttccaggagtcatagattgacgtttcgtgttcaaaacattgaagcttcattacctgccttggagaaggctgtattggcacaaacaagtcacatacatttagcttacacagctggttgtgaatggcatccacgcatgaaagctgctcaaaatcatttcatttacaatgacttgcctcactttattatggattcatatgaagaatgttgtgaccctccacgtgttcacttgcttgataaatttgatactggtggcccaggatcttgtttcaggagatattcagatccaaccttctttcaaagagtatctacagattcagacaaatcttactctgggaaaactgaaaaagcaagggaatctcataaaagcaagaagaaaaggtcacgaaggaatggagacattttaaggggtgaacagagtcatggcactagtggcagaatgaaatctatttcttctgctatcaatgggcgaacttcttcctcacaaacaacctccaccatagatatgacaatgaaatcagatctggaacattattcaaattcttttgattcaaaatctggtgctggctacattgaatgtgttttccatccaagtaattctaagcaatctgatgagccagattataaagcaccatcctctacaaaattgaaacggaaaaatgatactctgtcatcagtatctcatcatatagatgatagtatttcacatgatacattggaaaagcaagttgcctctagttcatctggtgttacttgggatgaaaaggaagagatagtggaatctaagagtcaagcatgtgatatagataaaactcctgagaggcttgctgttaccataaccagcattgactacaatcatatcctatttaatgaagaaagcaacctgaaaccagtctccaacagggttcaaactgatgatattgatagtgaacctgataattacgtggatgctctcaacaccattgaatcagaatctgaaaatgatattgattatataacaaaacgagaggttccttgcacaattgaaaattctgttttggataactcagtatgcactgatacctacattggttcttctactgttaatgatacagtgtcagcaccaattgagactgatatatcattttctggttccaataactctaatttaccagatgaggaagcaggtaagatcaacaacaatatctgcaaatctgaagagactcgtagagagtctttggctgatcattcagttaggttctggactaatggtggattattaggacttgagccatcaaaacctcctgactttaacaagtcaacttctttaagtcaaggcaatggttataaagaggaacgggaatcatcagaagacgttgctgagcagattctaaaggaaccaagttctagattcttaacatcaggccataatgatgaccaagcttgtatctctgaaaaggccactggcaattctcagcagagtaatggattttgtcagattgagaggaacagtttaggggaaatcaggggaaatggtgaaaactcatcccgtgtgtttggacttagtcgtagattactaataaatagctttcagcggaaatcacttcctgagacaacaacctccaaagagaaagttggttctggatatcctataaagtcacttcctccttcacctccacttgaacatatgaaaatatccttccatcctgtcagtggacttgagatctcgaaactaaaattgaaatttcctgatggcagtaatcgtcatgaaagcttaaaggatgtgtttccttctttccagttggtccctgaagcttcccttcctctggatggtttagtttctcactcagatgatgatgacactttctgtagatcatctccatatatatcagatgatggccgaagccctcgctctgactataattctgagcagtgggaatctgatgaaactcctgaaaacagtgaccaaggggtacatgattctcctcgcagaaggtcatcagctgaatctgtgtccattgatgataccaatgtaagaagtggacaaggtacatgtactacaaatggtgtggaacattctctatctaggcctttacttgattttccaagttatgataatgttaatcctgcacttgagaaagaaagtaaaagacactccaaatgcaataatgttatgtcacatagtcatgcagagcctacacaaccaccacctcctcctccacctcttcctccaacgcaatggcgagtctcaaaaccacagttggatatgacaaatgggacacaccatttgtctgaagatgctgaacatattgatgatcacggtattccacattctactatcttccagcagcctaggctcacccaggttgagcaattacaaattaatcacgatgatcatgaatcttataacaacattatatatagattgaaggacaagctggatccgcagaagttgaagggtcagaaggaagcaaaccagttgaaaatgggaaaggagacggatgaaagagaagatttcctatatcaaatcagaacaaaagccttcaacctgaggcccacagtaacaggaaagtcaaatgataccactggtcccaccgcaaacgtcaaagttacagcaattttggagaaggcaaatgcaatccgtcaggttgttgcgagtgatgatggtgaagatgatgataactggagtgatacatga

SEQ ID NO: 2923 - DNA, 1992 bp, Glycine Max
atgcctcttgcagctgcttcattagccttcaactatcagcaacttggtgacgcgggaaacgccaccctcagtatttctggagatgtctatcatgagcaagaagtcctccaactcaccaggtatgaaacatttagctatggtagagtcatatatcacaaacaattgcatctttgggacaagaactcaggaaaggttgcagacttcactacccatttctcttttaccataaacgcccgaaataacaccaattatgctgatggcatgaccttctttctggcacacccaagctttccagaactagatccaagagatggagttggtattggtcttttgagccgcactcaactgctgaatccaaatttcacaaaggaatatccatttgtagcagtggaatttgatacctatgttaatcccgagtgggatcctaaatatcaccatgtcggtatccaagttaattcttttgtcacttctgtctctgacactacacaatggttcactagcatggatcagagaggatatgatgctgatattagttacgattctgcttcaaacagattaagtgtcagcttcactgggtataaggataacgtcaaaattaagcaaaacttatcctctgtggtcaatctgaaagataaattacctgattgggttgaatttggcgtctctgcagctactggaatgtattatgaggaacatactcttagctcatggtccttcaactctagttttgtcttcgacaaacataagggtgggagcaaaaaaggcttggcagtggggatgggaatcggtggatttgttttgattggtgggacgggtttgatttcacttggcttgtggaagaagtggaagaaagtagatgaagaggaaaatcatattgttgaagagtatatgggtgaggattttgaaaggggggcaggacccagaaagtattcatatgctgaattagcacatgcagctaatggtttcaaagatgagcacaagctaggacagggtggatttggaggtgtttataagggttatcttaaagacataaagtctcatgtggctattaagaaggtatcagaaggctctgatcaagggataaaggagtttgcatcagaagtgataattattagccggttaaggcatcgaaatcttgtgaacttgattggttggtgtcacgaaaggaaaaagctcttgcttgtgtatgagtacatgtcaaatggaagcttggatattcatcttttcaagaagcaaagcattttgcaatgggcggtgaggtataacatagctcgaggattggcctcagcattgctatatttgcacgaagaatgggaacaatgtgtagtgcatagagacataaagcccagcaacattatgctggattcagagtttaacgccaaacttggggattttggtttagcaaggtttgtggaccatgcaaaaagtgcacaaactacagctttagctgggactatgggctacatggctcctgaatgtactttgggctacaggccggctagtaaggaatcagatgtctacagttttggagttgttgctttagagatagcttgtggaagaatacccataaaccatagggctcaagaaaatgaaataagtattgtgcagtgggtgtggggactctatggagaagggagaattcttgaagcagcagatcaaagactagaagggaaatttgaggaggagcaaataaaatgcttgatgattgttggtctttggtgtgctcaccctgaccataacaataggccttcaatgaggcaagcgattcaagtgcttaactttgaagctcccttgcctaatcttccatcaagtttgcctgttcctacatatcttgaaggccccttgcactcatacatagcaccattcagcataactgcttcagaggaaggtcaaagccagatcataagcttcagttccaacacaaactccattgggttcaccacaaaatctgatgatgcttctccctctgtgtcgcttctgtactcacggtga

SEQ ID NO: 2924 - DNA, 882 bp, Glycine Max
atgcctgaggctgaggaatacccaagtaaacttggggtgcccctttttgcatgcaaggatcagtcatttgaaattcagcatcaggacaatgagtacaaggagaacttcagaagcccccatttaggatcctcaagaagagtctcatccccagaaaccattagtcttgaatccaattcatatcaaagcaccaaagtgttcactgatgactgggagctcaattccccattttctgtcgtctcttcgctttatcaagaacctgaggcaaaattttctgtgcatgatcgagtgctttcagagcaaattatagaaggtgatgacaacgacgatgatgatgatattatgaactcctatgtcattgaactcaactccaacctcagaagggaagagtgtggagaatcagccattgatgaagcaattgcatgggccaaagagaagtttcaatcgcaaagctctgatgaagaatcaagtatgagaaacgatggcaaagagcaaactgttggaataggaagctctgatgcaagtgaataccatgacaatggaattggaatagttcaaactcaggagaagcgacagacagaaacagagaagttggacagtgatataagattgtggtcatctggcaaggaaacagatattaggctactactttcaacattacatcatattctaaggcctgagagtggctggtatgccattcctcttaagagtctattagaaagctcacaggtgaagaaggcttatcagaaagcaaggttatgcctgcatccagacaaactgcagcaaagaggagcgacactccttcagaagtatgtagcagagaaggctttctcaattcttcaggatgcatgggctgcattcatttccatagatgtttccttctaa

SEQ ID NO: 2925 - DNA, 1560 bp, Glycine Max
atgcctgcggtaggaggtattagcaacggagggggcaaggagtaccctggaagcctcactccttttgtgacggtaacatgtatagttgcagccatgggtgggttaatcttcggttacgatatcggaatttcaggtggggtgacatccatggatccgtttctgctcaagtttttcccgtcggtgttccggaagaagaattccgacaaaacggtgaaccagtactgtcaatacgacagccagacactgacgatgttcacgtcgtcgctgtatctcgccgcgttgctgtcgtcgttggttgcctccaccgtcacacgtaggttcggccgaaaactctccatgcttttcggaggcttgcttttcctcgtcggtgcccttatcaacggttttgcccaacacgtgtggatgctcatcgtgggtcggatcttgctcgggttcggtatcgggtttgccaatcagtctgtgccactctacctatctgaaatggctccatacaaatatagaggagcattgaacattggctttcaattgtcaatcacagttggtatcctcgtggccaatgtgttgaactacttctttgctaaaatccatggtggctggggatggagattgagtttgggaggtgctatggtccctgcccttataatcacaataggatcactagtccttccggacactcccaattccatgattgaaaggggtgatcgtgaaaaggccaaggctcagcttcggagagttcgcggcatcgacgatgtggaagaagagttcaatgaccttgttgcagctagtgaatcctccagaaaagtggagcacccgtggaggaacttgttgcaaagaaagtacagaccccacctcaccatggctgtgctgattccattcttccagcaactcactggaatcaatgtcatcatgttttacgcgccggtgttgttcagctccatcgggtttaaggatgattctgctctaatgtcagctgtgatcactggcgttgttaatgttgtggcaacttgcgtctcaatttatggtgttgacaagtggggtaggagagcccttttccttgaaggtggagttcaaatggtcatttgccaggctgtagttgcagctgctataggagcaaagtttggaattgatggaaaccctggtgatttgccaaaatggtatgcagttgttgtggttctcttcatttgcatttacgtatcagcatttgcctggtcatggggtcccctaggttggttggtgcctagtgagatctttcccttggagatccgttcggctgctcaaagtataaatgtgtcggtgaacatgtttttcactttcttgattgcacaagtcttcttgacaatgctttgccacatgaagttcggcttgttcatcttctttgcctttttcgtgttgatcatgacattcttcatctacttcttcttgcctgaaaccaagggcattcccattgaagaaatgaaccaggtttggaaggcacaccccttctggtccagattcgtggagaatgatgattatggcaatggtgttgagatggggaggggaactgctatcaaagaagtgtag

SEQ ID NO: 2926 - DNA, 978 bp, Glycine Max; identical to SEQ ID NO: 271

SEQ ID NO: 2927 - DNA, 933 bp, Glycine Max; identical to SEQ ID NO: 272

SEQ ID NO: 2928 - DNA, 1179 bp, Glycine Max
atgccttctacagaaaatcagggcttttcgttgtccttttcctcgtttggccgttccatatttggtgtcgggcaggagcaggttcattctgtggaagcaagtaatgaatctgattcctgtaatttagagctcgggtcattccaaaagcgtgttaccgatcgatttcaagacctttctgtagctagtgatgagcaatttctctcaattgattggattcagaagctcctcggagcatttatctgctgccaagaggaattcagagccatcctgttgaataacaaagagcaggtcacaaaacccccccttgatcgcatgatttctgaattctttgagaggtcagtgaaggcgcttgacatttgtaatgctagccgagatgggattgagaagattcgcacatggcaaaagcatctggaaattgtgttttgtgccttgggttcgagtaagagagcgttaactgaaggccatttccggagggcaagaaaggcactgatggatttagcattggcaatgcttgatgaaaaagagtctggatcagttttttctcagcgtaataggtcttttgggcgacataactctggcaaggatcatcactcctcatcagggcattcaagatcgcattcgtggagtgtctctcgttcctggtctgcagccaagcaactacaatccattgcgaataaccttgttccaccccgtgctactgaggttgctgcaacaagtgggcttgcgactcctgtttatacaatgaactgtattctcctgatagttttgtggacccttgttgcagccattccttgtcaggataggggtctaaacattcatttttcagtcccacggcaattatcctggagcactccggttacctcacttcatgaacgaatcacggaagagtcaaagaagcgagagcgccaaaactcaaatggtttgttgaaggagatatatcaagttgagataagcagccgccgcttgaccgacctgatagattcagctcagtttccgttggcagatgaccagaaaacagaagttgagcgcaatgtgatggagctgatgcgtgtttgtgaagctttcagaaatggatcggatccgttggagcgccaagtgagggaggtcttccagaagataatggcatgtcgaactgaggggctcgattatcttggcacgccaagccatacagagcaatga

SEQ ID NO: 2929 - DNA, 1179 bp, Glycine Max; identical to SEQ ID NO: 2928

SEQ ID NO: 2930 - DNA, 1647 bp, Glycine Max
atgccttcttcttctcaccctaataaccgtttcatcacacctgattcaactactcttatgaggaatgccaatggaggttttgttgatgaacttggaggcctgtgtgccaatttgagtcaaatgtacatcagcaatcagcaggagagcccttcaataatgttcaatatcatggggattcttacagtttcaggagagtcccctctttcttggactcctgtaaatcacgatgccgagataaattcggcgttaatggctaaattttttggatcaagacagtgtgccaaaatgtcttatgagacaatgctttctcaattacatgactttagtagttcaatggatcatcatcgtcattcaaggccgctgctgaggaatggaatgaatgtaactgaagaaacaggcatgtcgagatcgcctagctcttcttcccggggtattaatttaagaccttatttgggtgttcaagatttactgcagtatagccattccctgcctaattatagtgcaagagctgtgcctctttcaaatgctagaatcctacaaggaaatatagatgctattgcaagagaggagagcttcatcatacaaggtgaaggtgtaaattatgctgctagcataggtttggatcgttctatgtatcgtagtaaggctgtggtgcgagacactggcttcgccaggcatttgaagagatcagagttagacgtgccataccagtatagttccctagctgaagctcaaggttatatatatttaatgtccaaagatcagcatggctgtaggttcttgcagaaaatgtttgatgagggtacaccagaagatgttcaagtgatatttaatgagataattgatcatgtagtggaacctatggtgaatccttttggaaattaccttatgcagaagttattggatgtatgcaatgaagaacagaggatgcaaatcctactaataattactgaagaacccgggcagcttgtcagaatctctttaaacactcatggcactcgtgtggtacagaagctaatcgagactctcaaaaccaggcagcaaatttcattagctgtttcagctcttgaaccaggattcttggctctcatcaaagatctaaatggaaaccatgtgtttatatttgttgctgctgcaaagtattgtgttgacatcgcaactcaccaacatggatgttgtgttctgcaaagatgcattggccattcaaatggggagtatcaagaaaaactgattgcagaaatatgtgctaatgcacttctcctagctcaagatcaattcggaaattatgttgttcaatttatcttggacttaaagattccatctgccacagcatgcataaggttgcaatttgaaggcaactatgcgcacctatcaagacagaagtttggtagtcatgtggttgaaaaatgtcttgctgtattcaatgatgagaatcgatcaagagtcattcttgaactgctctccatgcctcactttgaacacttgcttcaagatccacatgctaactatgttgttcaatcagctcttcgacattctgagggccgtctgcacaatttactagttgaagcaattgagtcccacaaagccatttctcgaaacagcccgtattccaagaagattttctcgcagaagcttttgaagaaatga

SEQ ID NO: 2931 - DNA, 1224 bp, Glycine Max
atgccttgtgactctttcacttttctcaacactttttcttgttcctttttagcttcatctcgtttaaacaatttgaaagtttggatttttaatctcctggtttgttttccatcatggatggatatgataactaatgttaacgagtatgaggcaattgcaaaggaaaaattgccaaagatggtttatgattactatgcgtcaggggcagaggatcagtggactttgaaagagaaccaaaatgcattctcaaggattctgttccgaccgcggattcttgttgatgtaagcaagatagacttgactgcaactgtattgggcttcaaaatatcaatgcctatcatgattgctccaacagccatgcaaaagatggcccaccctgaaggagaattagctactgctagagcagcatcagcagctggcacaatcatgacactatcttcatgggctacttccagtgtcgaggaggttgcttcaacaggtcccgacattcgtttttttcaactttatgtgtttaaagatagaaatgtggctgctcagctcgtgagaagagctgaaagagctggttttaaggcgattgcccttactgtggacactccaattcttggtcgtagggaggctgacatcaaaaacagatttacattgccatcacacctggtattgaagaattttgaaggattggatcttagaaaactggacaagactagtgactctaatgttgcctcctatgttgctggaccatttgatcagtcattcaactggaaggatatccaatggctccaaacaatcacttcattgccaattttattaaagggtgtacttacagctgaagatacaaggatagccgtacaagctggagttgctggaatcattgtttccaatcatggagctcgccaacttgactatgtccctgctactattatggctttggaagaggtagttaaagctgcacaaggaaggattccagtttttctggatggtggaattcgtagaggtacagatgtttttaaagcactagctcttggagcagctggtgtattcattggtagaccagtgctgttttcattggctgctgatggtgaggctggtgtgagaaaagtacttcaaatgcttcgtgatgagtttgaactaactatggctctaagtggttgccgttcactcaaggagataactcgtgaccatgttgtcacagagtgggatcgcccaagatttgctcctaagttatga

SEQ ID NO: 2932 - DNA, 1488 bp, Glycine Max; identical to SEQ ID NO: 273

SEQ ID NO: 2933 - DNA, 1860 bp, Glycine Max
atgcgaacttcatgggctgatttggctgcaaattctgcagccgaaaatgcaggtcctggttcttctgctgacaatgtgggaactggtagcactttagctcccacgcgacctgtttatgtacctcctcatctgaggaaccgtcagccagcagcagaatcccctgcccctgctccagcatatagtggcccttcttctggtgctggctctagttctggtgctggtaattctggatcccgttatgctgcacccagaaatgattatcgtcctgggtatggtggtggtggtggacgtacaggtggatggggaaacaaaagtggtggatgggatcgtggcagggagcgggaagtcaatccctttgaagaagaggataacgctgaagaggcattcagtgagcaggagaatacaggaataaattttgatgcatatgaagacattccagtggagaccagtggtgacaatgtgcccccacctgtgaatacgtttgcagagattgatttgggtgaagcacttaatcagaatataagaaggtgcaaatatgtgaagccaacacctgttcagcggcatgccataccgatatctctagctggacgggatttgatggcttgtgcgcagactggttctggaaagacagctgcattctgcttcccgattatcagtggaatcatgaggggccaacctgtgcagaggccacctcgtggggtgcgtacagtgtatccgcttgcgcttgttctttctccaacgagggagttatcaatgcaaatacatgaagaggctaggaagttttcataccaaactggggttagggtagttgttgcatatggtggagcaccaataaaccagcagctgcgggatcttgaaagaggggtggacattcttgttgcaactcctggaagactggtagatttgctggagagagctagagtttcactgcagatgattcgatatctggcattagatgaggcagatcggatgctggatatgggttttgagccacaaataaggaagattgtagagcaaatggacatgcctccaccaggtgccagacagactatgttgttcagtgcaacatttccaaaagagatacagagattggcttctgatttcctttcaaattatattttccttgctgttggaagagtgggttcaagtactgatttaattgtccaaagagttgagtatgttcaagagtctgacaagagaagtcacctaatggaccttcttcatgcacagagggcaaatggtgtacaaggaaagcaagctttaactttagtttttgtggagactaagaagggagctgattcgctggaacattggttgtgtcttaatggttttccagcaactactattcatggtgacaggtcacagcaggaaagagaattagccttgaggtcatttaaaagtggcaacacccccatattggttgccaccgatgttgctgcacgtggtcttgatattccccatgttgctcatgtggtcaactttgacctgccaaatgacattgatgattatgtacaccgaattggaagaacagggcgagctggaaagaaaggtcttgcaactgcattctttaatgataacaattcatcgctagctagagctttatcagaactgatgcaagaagcaaatcaagaagtacctgcttggctctcacggtatgctgctcgatcttcttttggtggaggcaggaaccggcgatcaggcggtcgatttggtagtcgtgactttcgaagagagggctctttcagtagaggttcttctgattactacagtgcgggaaacagcagtggtggtggatatggaggctctggtgggtatgctggtggagggtatggtcctggggtcactagtgcttgggattga

SEQ ID NO: 2934 - DNA, 1653 bp, Glycine Max
atgcgaagaacgaacgagagtgcagcgccagcggcaatgggaaggagcactttggctttggttctcgcgattctgatctctttgcagggaaccccccacgttagatccgatgcctccgatcatcgttacaaggacggagactccgttcctctttacgccaacaaagtcggtccctttcacaaccccagtgaaacgtatcggtactttgacctgccattctgtgtaacaggtcatgagaaagataagactgaagccctcggtgaggtgttaaatggcgatcgccttgttagtgctccttatgaacttagtttcaagaaggagaaagactctaaggttgtatgcaagaggaagctcacaaaggagcaagttgctcagttccgagaagcagttaagaaggactattatttccagatgtactatgatgacttgccgatctggggatttattgggacggttgacaaggaagggaaaactgaccctagtgagtacaagtattttctttacaagcacattcagttcgatattcattacaacaaagatcgagtcattgaaatcagtgcccggatggaccctcattctgtggtggacctgactgaggataaagatgtagatgttgagttcgtgtacactgcaaaatggaaggaaacagagactccttttgagaagagaatggataaatactcccagtcttcttctttgccacatcacttggagattcactggttctcaatcataaattcctgtgtaacagttcttcttttgactggttttctggcaaccattctcatgcgtgtattgaagaatgactttatgaagtatgctcaagatgaggaagctgctgatgatcaagaggagacaggatggaagtacattcatggggatgttttccggtttccaaagttcaagtctttcttttcagcagcccttggttctggtactcaattattcacacttacaatcttcatttttatgcttgcactggttggtgtgttttatccatataaccgaggcgctttatttactgcactggtggtcatatatgctctcacatctggcatcgctggctacactgctacttccttctatattcaacttgaagggactaattgggttaggaacttattgctgacaggatgcctcttttgtggccccctattccttatgttctgtttccttaacacagttgcgattgcttatagtgcaactgctgccctgccatttggcacaattgtggtgattgtcctaatatggacattggtaacttcaccattgcttgtgttgggtggtattgctggtaaaaatagcaaaactgagttccaagcacctgtccgcactacaaaatatccccgagagattccacctctgccttggtacaggagtaccattccccagatggcaatggcaggatttcttccttttagtgccatctacatagagctgtactacatttttgccagtgtatggggccacagaatttatacgatctacagcatactcttcattgtcttcattattctgttgattgtcactgctttcatcactgtggctttgacatacttccaacttgctgctgaggatcatgaatggtggtggaggtatgcaacttatcttattgccaccttctatagttgtttgagagttgagtttgtgtaa

SEQ ID NO: 2935 - DNA, 1815 bp, Glycine Max
atgcgaagaacgaacgagagtgcagcgccagcggcaatgggaaggagcactttggctttggttctcgcgattctgatctctttgcagggaaccccccacgttagatccgatgcctccgatcatcgttacaaggacggagactccgttcctctttacgccaacaaagtcggtccctttcacaaccccagtgaaacgtatcggtactttgacctgccattctgtgtaacaggtcatgagaaagataagactgaagccctcggtgaggtgttaaatggcgatcgccttgttagtgctccttatgaacttagtttcaagaaggagaaagactctaaggttgtatgcaagaggaagctcacaaaggagcaagttgctcagttccgagaagcagttaagaaggactattatttccagatgtactatgatgacttgccgatctggggatttattgggacggttgacaaggaagggaaaactgaccctagtgagtacaagtattttctttacaagcacattcagttcgatattcattacaacaaagatcgagtcattgaaatcagtgcccggatggaccctcattctgtggtggacctgactgaggataaagatgtagatgttgagttcgtgtacactgcaaaatggaaggaaacagagactccttttgagaagagaatggataaatactcccagtcttcttctttgccacatcacttggagattcactggttctcaatcataaattcctgtgtaacagttcttcttttgactggttttctggcaaccattctcatgcgtgtattgaagaatgactttatgaagtatgctcaagatgaggaagctgctgatgatcaagaggagacaggatggaagtacattcatggggatgttttccggtttccaaagttcaagtctttcttttcagcagcccttggttctggtactcaattattcacacttacaatcttcatttttatgcttgcactggttggtgtgttttatccatataaccgaggcgctttatttactgcactggtggtcatatatgctctcacatctggcatcgctggctacactgctacttccttctatattcaacttgaagggactaattgggttaggaacttattgctgacaggatgcctcttttgtggccccctattccttatgttctgtttccttaacacagttgcgattgcttatagtgcaactgctgccctgccatttggcacaattgtggtgattgtcctaatatggacattggtaacttcaccattgcttgtgttgggtggtattgctggtaaaaatagcaaaactgagttccaagcacctgtccgcactacaaaatatccccgagagattccacctctgccttggtacaggagtaccattccccagatggcaatggcaggatttcttccttttagtgccatctacatagagctgtactacatttttgccagtgtatggggccacagaatttatacgatctacagcatactcttcattgtcttcattattctgttgattgtcactgctttcatcactgtggctttgacatacttccaacttgctgctgaggatcatgaatggtggtggaggtctttcctttgtggtggatcaactggcttgttcatctacggctattgcttgtattactactatgcacgatcagatatgtctggttttatgcaaacttcgttcttctttggttacatggcctgtatctgctatggcttcttcctcatgctcggtagcgtaggattccgtgcctccctgctctttgttcgtcacatataccggtccatcaagtgtgagtag

SEQ ID NO: 2936 - DNA, 345 bp, Glycine Max; identical to SEQ ID NO: 274

SEQ ID NO: 2937 - DNA, 369 bp, Glycine Max
atgcgatcgaatcggagcatggagggagggaagagaaaagggtacgcgtgggcactatctgctggattcaacgccgctcttgcagccatttccgttaagctccctcttcaccagtttgttaggtatgggatggtgttattgttcaatgtgaccatgtgggcttgttatgtgaacagcctcaaagcgctctcctctcttcaggcaactgtcaccaatttcgccaccaatttcatctcttccggtttagccggtttcttcttctttcacgaatcactctctttccagtggtttgcaggtgccatacttataataattggtgtagtaatacttagcaactcaagtattgagaagaaggttagcactgattag

SEQ ID NO: 2938 - DNA, 3021 bp, Glycine Max
atgcgtagttgcattattgtatgtggcagttcacagcataagagacaacagatcaagccttccgcagagggaggtctccgtcagaatcaagatgaagaagacgatgctgccgaggtttcgttgaacaacgatgattctgtggagaatttgaatgacgcaaccgcgcctttgggtacccatatcatgaatctcaaccattttttccttgttagacgtggacctatgtatttcttttctatcttaatattacaatatgatgtgcaaaatgtcaaacatgagtcctttagtaacacacattactcactgcaaattttgttgcatggtcttctcagtataataggctggatagaccagtcattttgttacatggacatacttagcaaggaaaattggagagagcaggctgaacagttatctggtaggcaacttgaggatttgctgggaatgataaaaaatgcagagaaaaacattcttcttttaaacgaggctagagttcgttcacttgaagatcttgaaaagattcttgcagaaaaggaagcattgcaaggagaaattaatgtcttagagacgaggttggctgagactgatgcacagattaaagttgccaaccaggaaaagatacatgtggagctcttggaggggcagttagagaaactgcgtaatgagttggcccaaaaggaaagtttgagtgatgcaaaccctctaagtcataatgatagcattcattccctaactgaggagcttaattcattaagagcagaaaatgcctctttgaagaatactatagaatcatttaaaacacagcttagtgataccaagaataatgatgaacgtttggtggcattggaaaaggaacggtcctctttggaatcagccctaaaagacttggaatcgaaactatcaatctctcaggatgatgtatcaaaaatttctacgcttacagttgaatacaaggatttgtgggataaggttgaaaatttgcaatcattgctagataaagcaaccaaacaagctgatcaagctgttattgtgctgcaacaaaaccaggatcttcgaaggaaggttgataaattggaagaatctcttgaagaagctaatatctataagctatcatctgataaactgcaaaaatatagtgaactaatgcaacaaaagttaaaactattggaggaccgtcttcaaaaaacagatgaagagataaattcttatgttcagctatatcagcagtcagtgaaggaatttcaagatacacttgatactctgaaagaagaaagcaagaaagggaatttagaagaaccggtggaagatatgccatgggaattttggagtcaactgttacttctaattgatggttggaaactagaaaagaaaatatcagtagatgatgcaagtcttttgcgggaaaaggtgtggaagagagacaggcgtattattgatacatatatagcttgcaaaaaacagagtgaacaggaggctatttctgcgtttcttgggcttttatcatctgcaacaagtcctggattacatgtgattcatattgcagcagagatggcaccagtagctaaggttggtggtttgggggatgttgtcagtggtctaggtaaagcactgcaaaagaaaggacaccttgttgaaattgtgcttcccaaatatgattgtatgcaatatgaccgtgtctgtgacttacgggctttggatgtgctgatagattcatactttgatcgtcaattatacaaaaataaaatctgggttggcactgttgaaggccttcctgtttatttcattgagccccatcatcctgataagttcttctggagaggagaattttatggcgagcgtgatgatttcagacgattttcattttttagccgtgcagctcttgagtttcttcttcgagctggcaagaagccagatatcattcattgccatgattggcagacagcattcattgctcctctgtactgggaaatatttgccccaaaaaaaggattaaattcagctaggatatgctttacatgccacaactttgagtatcaaggaactgcagcagcttcagagttagaatcatgtggtcttgaaagccaccgtctaaacagaaaagatagaatgcaggacaactcatcacatgatagagttaattctgtcaagggtggaattgttttctcaaacattgtgacaacagtttcacctacttacgcccaagaagtgagaactgaagagggaggacgtggtctccattcaacactctctgtccactccaaaaagttaattggtattattaatggtattgatactgatgcatggaatcctgccaccgatgcatttcttccagtccagtacaatgcaaccgatcttcaaggaaaagcagagaataagcaagccttgggaaggaacctaggtctttcatctacagatgttaggagacctttggttggctgtataacaagattggttccacaaaaaggtgttcatcttattagacatgcaatatacctaacattggaattgggaggacaatttgttctactgggttccagtcccgtgccacacattcagaaagaatttgagggaattgccaaccactttcagaatcatgatcacataaggttgatattgaagtatgatgaatctctctcccatgccatttatgcggcgtccgacatgttcatcattccatcaatctttgaaccttgtggcctaacacagatgatatcaatgagatatggcgccatacctattgtcagaaaaactggtggcctaaacgacagtgtttttgatgttgatgatgatacaataccttcacagtttcgaaatgggtttacattcgtgaatgccgatgaacagggattaaacggtgctctggtacgggcatttaatctcttcaacaacaatcctgagggttggaagcaacttgttcagaaggacatgaacatagatttcagctgggaaacatcatcagcacaatatgaggagctctacctaaagtctgtggctagagcaaaggcagcaaaaggtgcttaa

SEQ ID NO: 2939 - DNA, 1326 bp, Glycine Max
atgcgtgagattcttcacattcagggagggcaatgcgggaaccaaataggaacaaagttctgggaagtggtgtgtgatgagcatgggattgataccacagggcagtacgtaggcaactccgaacttcagcttgaaagagtgaatgtttattacaatgagggaagcaatggacgttacgtgccacgggcagtgctgatggaccttgagcctggcaccatggatgctgcccgcaccggcccttatggccagattttccggccggacaactttgttttcggtcagtcgggcgccggaaacaactttgcaaagggccattacactgagggtgctgagcttattgactccgtccttgatgttgttaggaaggaggttgagaattgtgactgcttgcaaggatttcaagtgtgccactccttgggtgggggaacgggttctggaatgggaactctgctgatttcgaagatcagagaggaataccctgatcgaatgatgctcacattctctgtgtttccatctccaaaggtgtcagacacggttgttgagccttataatgctacactttctgttcaccagttggtggagaatgctgatgagtgtatggtccttgataatgaagcgctatatgacatctgcttcaggaccctcaagctcgctacgcctagctttggagacttgaatcatttgatatcagcaacaatgagtggagttacttgttgcttaagattcccgggtcagctcaactcagacttaaggaagctagcagtgaacttgatcccatttccaagactccactttttcatggtgggttttgctcccctaacttctcgaggatcacagaactaccgcgcactttctgtcccggaactgacacaacagatgtgggatgccaagaacatgatgtgtgcagctgatccacgccacggtcgttacttgacagcctcagcagtgttcagaggcaaaatgagcacaaaagaggtggatgaacagatgttaagcgtgcagaacaagaactcttcctactttgttgagtggattcccaacaatgtcaagtctagcgtctgtgacatccctcccagaggcctttccatggcttcaacttttgtcggtaactcaacttctatacaggagatgttcagaagagtgagtgagcagttcacagccatgttcagaaggaaagccttcttgcactggtacacgggagaaggaatggatgagatggagtttactgaagcagagagtaacatgaatgatcttgtagctgagtatcaacagtaccaggatgcggcggctgatgaagatggtgattctgaagaagaagatgagggt

SEQ ID NO: 2940 - DNA, 1002 bp, Glycine Max
atgcgttctcagcttgtgaaatcgaatatcaaaacccctccaaggccaaaacggcgtcgtcaaccactcaaatcatggcctgttactttctccccctttgctcgcgctctcgctctctctcgcatcacctctctctctccaccaaaccctaccccaaccctctctgctaagaaaccgcaaccctctcatggatctgtccatgcagatttatcccaaccggaacactccgagtcttccgacgaggacttcgatggagttgtccaagcagatttttcatttttcgatcccaaacctaatgattttcacggagccaagaccttgctgcaaacctacctcgacgaccaggaatgggatttgagtgcctttgtagacttgattttggcacagaccaccgtaggctctgttgttaagatagaggacgacgaggatgaagggctcttcgctcttgttactgctcttaatttatatagatacagggagcataagtgtattgcgacagttaaggattttctcctccataaagtgcgccaagagaagagtgtccatgaccagttgaaattgctgttgggggagcaagcgcatgatgttggtctcctggtatcgcagcgcatggtgaaccttcctccccagcttctgccacctctttatgatgccctttttgatgaagtgtcctgggccacggaagatgagccgacggaggagctccagaattccttcaagtttaagcattatataatacttaccaaaatttacgtgctcaagaatgtagaacagaaaagaaaacagagcaatggtagtgatgaggcaataatatacataaagcttgaggatgaaatttttcacaagttaagctcgtggtccttctgttttccattgcaaactcagcagcttgcacctcatgagctgaggaattacaggtcaacgggattaatcgtggctgttgaagctgacaaaattccaacatttcgtcaagaattagcttctctaataaatgaaacctga

SEQ ID NO: 2941 - DNA, 936 bp, Glycine Max
atgcgttctcagcttgtgaaatcgaatatcaaaacccctccaaggccaaaacggcgtcgtcaaccactcaaatcatggcctgttactttctccccctttgctcgcgctctcgctctctctcgcatcacctctctctctccaccaaaccctaccccaaccctctctgctaagaaaccgcaaccctctcatggatctgtccatgcagatttatcccaaccggaacactccgagtcttccgacgaggacttcgatggagttgtccaagcagatttttcatttttcgatcccaaacctaatgattttcacggagccaagaccttgctgcaaacctacctcgacgaccaggaatgggatttgagtgcctttgtagacttgattttggcacagaccaccgtaggctctgttgttaagatagaggacgacgaggatgaagggctcttcgctcttgttactgctcttaatttatatagatacagggagcataagtgtattgcgacagttaaggattttctcctccataaagtgcgccaagagaagagtgtccatgaccagttgaaattgctgttgggggagcaagcgcatgatgttggtctcctggtatcgcagcgcatggtgaaccttcctccccagcttctgccacctctttatgatgccctttttgatgaagtgtcctgggccacggaagatgagctcaagaatgtagaacagaaaagaaaacagagcaatggtagtgatgaggcaataatatacataaagcttgaggatgaaatttttcacaagttaagctcgtggtccttctgttttccattgcaaactcagcagcttgcacctcatgagctgaggaattacaggtcaacgggattaatcgtggctgttgaagctgacaaaattccaacatttcgtcaagaattagcttctctaataaatgaaacctga

SEQ ID NO: 2942 - DNA, 561 bp, Glycine Max
atgcgttcttatggcttaaccgtaccgggaagcgaccaccgcttctgcgtgcccaccgtatctcaggtgttctttaggcccaacaggcccattaaccgaatcgcgtttcccaaggccaccctcaagaacgacggcttcgtggtggacctgagcttctacgaccttctgggaataccggaatccggttcggtaacggagatcaagaacgcctacaagcaactcgcccgaaagtaccacccggacgtgtcgcctccgggtcgggtcgaggagtacacaaagaggtttattcaggtgcaggaggcctacgaaaccctgtctgatccttccagaagagctatgtacgacaaggacatggccaagggcattaacttcgccttcaacgcccgcagacgctataattaccacgatcaggtagttgaacaaaaaagtgaatggaaagctaggtggaaatctcaactgtcagagctgaagagaaaaagtaacggcaaggatgctggagggaatatgtcatgggcggcacgaatgcgccaacagagggatgaattgtcaaatgaatcatga

SEQ ID NO: 2943 - DNA, 1251 bp, Glycine Max; identical to SEQ ID NO: 275

SEQ ID NO: 2944 - DNA, 714 bp, Glycine Max; identical to SEQ ID NO: 276

SEQ ID NO: 2945 - DNA, 213 bp, Glycine Max
atgctactactctctgcaagtgcaacctcttggattggttttagctctacaccatttgaaatatggatagggatctcaacatggtttgttgaaattccattattagttctacctccaaggttggccatgaaggatgataaaggtaaaatgaagttggaaaatactgagagatggatcaaaaaggagggagttaatggaaattatgtgatatga

SEQ ID NO: 2946 - DNA, 864 bp, Glycine Max; identical to SEQ ID NO: 277

SEQ ID NO: 2947 - DNA, 747 bp, Glycine Max; identical to SEQ ID NO: 278

SEQ ID NO: 2948 - DNA, 300 bp, Glycine Max
atgctagctaaaaccaacgtgccccatgagaccttatctccacagaagattcatgtccaacatgttccaaagtgtgtgtcggataggttgctagagaagttctatgatgagtcagagttggatttcgattacgagcaaagtggattgtggtctcctccagttccacgcacggtattcttgagctcaccggggagaatattcactgagcaagaaatgcttgaaagactcagaagcaaaaatgcatcacgaagacgtggcaaaagattcagagtttgtttcagtgtgttatgttgtgcctga

SEQ ID NO: 2949 - DNA, 249 bp, Glycine Max; identical to SEQ ID NO: 279

SEQ ID NO: 2950 - DNA, 1677 bp, Glycine Max; identical to SEQ ID NO: 280

SEQ ID NO: 2951 - DNA, 843 bp, Glycine Max
atgctcagacggaggctatctgttctctcaacatcaatcaccagaagctcaaattatagcaaacccagtctcggatacccatctatccaatctcatccctttcagctccctcactctcccagtgcttatcaaataattagtcctaatgcattcccggattttcaaggttttagagcttacagtcttctgagcttgaatgatctgagagataaggttcccagaaaacagccgacgaggaaggggcgtgggattgggtctggaaagggcaagactgcagggaggggtcacaagggtcagagagccagaaaaggtataaaattggggttcgaaggaggtcagacccctcttcgccgaagattacccaaacgtgggttcaagaacccatttagcctcacttttcagccaataggtttggggaaaattgcaaagtttattaatgctgggaagatagattcttctgaactgattacaatgaaaacactaaaggatgcaggggtactagggaagcaaatgaaagatggagtaagattgatggggcgtggttctgagcagatcaagtggccaattcatctagaggtatcaagggttactgttagggctaaggaagcagttgaagcagctggtgggtctgtgagaagggtgtattacaataagttgggcttgaaggcactggtgaagcctgagtggtttgaaaagaaaggaagattgctgcctaaagcagctagacctcctccaaagcaaaaggataaagttgatagcattggtcggttgcctgccccaacaaagccatttccatttttagttgaagcaagcaaggatcttccagttcagcatcttagttga

SEQ ID NO: 2952 - DNA, 1257 bp, Glycine Max; identical to SEQ ID NO: 281

SEQ ID NO: 2953 - DNA, 1893 bp, Glycine Max; identical to SEQ ID NO: 282

SEQ ID NO: 2954 - DNA, 1461 bp, Glycine Max
atgctccgccacaacactctccccaaccaccgcaccgttgcttccctcttcaccacctgcgccgccctcactgccgtctctttcgccctctccctccactcactcgccctcaaactctctctctcccaacaccccttccccgcctcctccctactctccctatacgccaaactccgcatgcccctcaatgcacgtaaggtgttcgacgaaattccccaaccagacaacgtttgtttctccgccttgatcgttgcactcgcccagaattcccgctctgtcgacgcttcatcggtcttttccgaaatgaggggtcgcggttttgcgtccacggttcatagcgtgtccggggttttacgtgctgctgcacagcttgctgcattggagcagtgtagaatgatgcatgcacatgcagttgttctggggcttgattctaatgtggtggtgggtagtgcgcttgttgatgggtatggtaaagcgggtgttgttaacgatgcaaggagggtttttgaggataatttggatgatatgaatgttgtggggtggaatgcaatgatggctggttatgcacagcagggggattatcaatctgcttttgaactgtttgagtctttggaaggctgtggactcgtgccggatgagtatacttttttggcgatattgactgccttgtgtaatgctggaatgtttctcgagattgctccgtggtttacgaggatgagagtggattatggtttggaaccgagtttggagcattatacgtgtttggtaggtgcaatggcgcgtgctggagaattggagcgtgcagagagggttgtgttgacgatgccgattgagccggatgctgcagtttggcgagctttgctatcggtttgtgcgtatcgtggtgaggctgacaaggcttggagtatggcaaagagggtgttggagctggagccgaatgatgattatgcttatgttagtgtagctaatgtgttatcgagtgcagggaggtgggatgatgttgcagagttgaggaagatgatgaaggataggagggtgaagaaaaagggtgggagaagttggattgaagtgcagggagaagttcatgtttttgtggcgggggattggaagcatgagaggtccaaggaaatttatcagaagttggcagagcttatgggggatattgaaaaattagggtatgttcctgtttgggatgaggtgttgcataatgttggggaggaaaagagaaaggaggccctttggtatcatagtgagaaattagcagttgcatttggagtgttgtgtggacctgcaccaccagggaagccgttaaggattgtgaagaatttgaggatttgtaaggattgccatgaggcttttaagtacatgacaagagttatagaaagggaaattattgtgagggatgtcaacagataccacagatttgtgaatggtaactgcacttgtagtgacatatggtag

SEQ ID NO: 2955 - DNA, 1581 bp, Glycine Max
atgctccttattttctctttcttcttctattgttttcacttttgtaagaccattctccaatgcctctctctccattctgacccttctcgtccaatctctgcagtcacctatttcccaaaaaacccttcataccctcccattttggaggcctacatcagaaacctgaggttcagttcccccacaaccccaaaaccaaccttcattgttgcaccaacacacgtgtcccacatccaagcctccatcatctgctgcaaaaggttcaatcttgagatcagaacaagaagtggggggcacgactttgaaggcctctcgtacatgtcacaaaccccatttgtgattgtggacatgttcatgctgaaatcagtggaggtcgacgtcgaggaccagacagcgtgggttgactcggggtcaacgattggtgagctttactatgctattgctgagaagagtagggtcctaggtttccctgctggtgtgtgtcacagtgttggtgttggagggcatttcagtggaggagggtatgggaacatgatgagaaggtttggtctctcagtggataatgttttggatgccctaattgtggattctgaaggaagagtcttggatagggcaacaatgggtgaagatcttttctgggccattagaggaggtggtggtgctagctttggggttattgtttcatggaaaattaggttagttcctgtgcctgaggttgtcacggttttcagaattgaaaaaacattggaacaagatgccagtgatcttgtttttcagtggcagtatgttgctgataagatacacgatggcttgttcattagggtggttcttagtcccgtgacgagatcggatcggaagacaataaaggccaagttcaatgccttgtttcttggaaattcacaagagcttctttctgtgatgaatcaaagtttccctcaactgggtttggttgccgaacagtgcattcaaatgagttggattcagtcggtgttgttttgggataactatccggtggggacttcggttgatgttttgcttcaaagacatgcaacaaaagagaaattcttgaagaagaaatcagattatgtgcagcaacctatctccaaagctgcccttgaaggtatatggaagatgatgatggaactagaaaagcctgttttcacattcaacccctatggtgggaaaatgggtgagatttctgagttcgaaacaccgtttccacatagatttggtaacatatttaaaattcagtactctgtgagttgggatgaggagggtgaagatgttgctaaacaatatttatatcagattcggaggctatatgattacatgactccttatgtgtcatactcacctagaagttcatatctgaactatagagatgttgatataggcgtcaatggccctggaaatgctacttatgcacaggctagtgtttggggtaggaagtatttcaagagaaattttgataggctggtgcaggtaaagaccaaggtagatcctagcaattttttcagatatgaacagagtattccatcacttgcatctgctcatagtatagtgtcagaaaagaagaagccttga

SEQ ID NO: 2956 - DNA, 1824 bp, Glycine Max
atgctgaacctgaaccagcccttaaacgccgccggaaccgcgaacgaagatgtctacaagatcctcatctacgacaagttctgccagaacatcctttccccattgatccacgtcaaggacctccgcaagcacggcgtgaccctctacttcctcatcgacaaggatcgaaaacctgttcacgacgttcccgcggtttatttcgtccaacccaacgtttccaacgtgcaacgcatcgtttcggacgcgtccaaatcgctctaccagagcctccacctcaacttctccacctccatcccgcgccccctcctcgaagacctcgccgccggaaccctaaattcggattcgattcagcgagtctcgaaggttcacgatcaatatctggaatttgtaaccctagaggataaccttttttcactggcccacaagccttgttatgttcaactcaacgatccttccgctggggacaaggaaattgaggagcttgttgagaagatcgttggtgggttgttttgtgtgttggccactcttgcggttgtgccggtgattcggtgcccgcgtggcggtcctgcggagatggtggcttctgcattggatcagcggattagggatcatttgttgtccaagaataacttgtttactgagggtgggaactttgtgagctcgtttcagcgtcctgtgttgtgtatttttgaccggaatttcgagttgccggtggcgattcagcatgattttcgctaccggccgcttgttcatgatgtgcttgggttgaggctgaataggctgagtgtgcagggggagaagggtgggatgaggtcttatgagttggacagtgctgattcgttttgggttgcaaatgggtcgctggagtttccggaggttgcggtggagattgagacgcagttgaataagtataagaaggatgtggatgaggtgaacaagaggactggcgggactcatggcgcggagtttgatgggacggatttgattgggaacacgaagcatttgatgaatgctgtgaattctctgcctgagttgactgagaggaaacaggtgattgataagcataccaacattgcgactgtgttgttgggcgagatcaaggagaggtctcttgattcttatgctaagaaggagaatgacatgatggttagagggggcattgaacggggtgacctgcttggtgtgctcagagggaagggaacgaagatggataagcttaggtttgccatcatatatctcatttcatcggaaaccattaatctgtcggaagtggaagctgtggaagcggcactgagagagtctgaggttgatactgctgcttttcagtatgtgaagaagatcaagtcgttgaatgtgtcgttggcatcggcaaattctgccagcagaagtaatattgttgattgggctgagaagctctatgggcagtcaattagtgcagtgacggctggtgtcaaaaatcttttgtctaatgacaggcagctagcattggcaaggacagtcgaggccttgattgaagggaggacaaatcctgaaacagatgtgtacctttcgtttgatcctcgtgctccgaagtctggttcgggagcaagtagcagccatttgaaagggccatttaaggaagcaattgtgttcatgattggtggtggtaattacgttgaatattgcagtctgcaagagcttgcacaacatcagcaacctgccaaacatattatatatggaacaacagaaatgctaactggagttgactttgtagagcagctaacattgttggggcagaagatgggtttgggtaatgttggttctagttctaccccagctcagtag

SEQ ID NO: 2957 - DNA, 2880 bp, Glycine Max
atgctgaatagttctagtagaagctacagatcagtaaacaacgggcaaatttccaatcagatggttccatatgggaaagctcagagctcaaggcaaacgggtgatctgtcccttgccctggcttttgcatttgagaatggagggaaactaagaaggaatgattcaattatgggtttccttcaccaaattaaaaggggaacattggaattcagcatgtcagaaagacaatttgcttcaactagcaactaccctatgcagataaacgagatatccaaaggtgcacaaaaactaaatcagatattgagagccggctccaatggtcttaacatggactcatattcaatacaatttgcaaaggaactattacaaggagctattgatttggaagagtccctcaggatgctagtagaccagcaaaataattcacagtttatgattacatcacagaagaaaaatagaataacactattagaggaggataatgatgataacaatgacacagggatggaaatgcaactggcacaaccaactctctcttttgacaagcatactactgagaacatccaacaatttgggaagactattttcatgcagaggccaattactcttaccagctctaaggaaggcagaaactcaaataatgaaaacaaaaatatggcctccaacccagagaagggcaggattccaaatgtgatagccaaactaatggggctggacatccttcctgacaaagtggaaaaggaatcaaaacaggcaatgctagtgaaaagagaaggaacatctcccaagcatactgctaaaggaagcattaagaagactgaactgaagagcaaagaaacggataatttgatgcctatgaaaaaccaaaaagtgatagaagccttcaaagtgccttcaactcagggtgaagagatgatatttggagcaaataaaaatttgcttgtcgagaagactagctctgaggtggctgttcggaatggaataaaaacactgaaaggatttgacaaacccagcataaaaatagacaagcctactaaaagttcccctcaaaagaaccttaccagagaaagtcaaaaggatgttcaggaaataggaagaaaacagaataacccaaataacaataacagggaacagaaaggcacactggaacaagtgcgtgaaagatcacaagttaagtccttaactcaggaagacaaggaaatcaatggaaatattgttcagcccgaaaaaagacacacaaacacactcgccatgaacaacgaaaagaagccttggaacaatgttggagttcaaaagtcatatgtactctccaaaaatgggcctcatgaagaaaagcatcgcagagaacagcaactccagctgagggaagaacatatgttgatgatgagaccacaaggaaggagtgaaatgacttccatgaattcaccaaaatcccctcatcaattgatcaatcctcagaagaagcagctatccacgaaccaggtcacactgtttaagaaaaactctggagaaaaaaatgtcgcttctatgaaatcggagggcttcttaactaatcactatgatccagtcagagatgaagcatccaatgccacaaatgagaatgtaaaagaaattatccataggaagtcaggccaaatttcctctccaagagatcaagaatttgaacgagctaagcgaagtggcatcaaaactttgatggatgaaaaacacatcaataaactggccagcaagaaaataaagaatactagaaaacaaaaagttgacatgtctggaaagattgatcaaatgttgactggaagaaatggagccaagctcatcactgaacaaggaaaacaacagattcccactcctgacaaattccaagttttgaatgaagcggaacatgaaagggttagcatgctcagagaaacagatgtgcacatcattaactccaatgaaccagtatctgtggctgtgactgaaccattggatatgaggcaccaaccccataaagaagctgaactgcctcctacattatccagttctgttggtggagaacttcaaagccaacaagaattggtagcagtagttcccaatgatttgcattgccaagatgtgcaatcgttgcaagatcaagctgctcctatggcagcagatgaaggattcgtaactggtgaagtcgaattacataaaacaaatgcttctcatgtcatgcattcacaaagttccctttaccagttctcgtccattatcttccttcgcccttcatatagttataatctttcttctggttcatcattggcaaaaagttgcaaaagaaataattcaataaaaaatatagatggaatgaatcaatttaacatccgacagccactaacagaaagtgaaaactgcctcaagttgattctggtcatgagtcaactattcgtcaacactgcagaagcacttttcaaactcaacatcccatttaacgttcttcaaggtggtgatcgggaaaatcaagacgaaggtagcaaactcacattagactgtgggtatgaagtgatgaaaagaaaggggatactacaggaactcaaagttcattgttattcaaggatatcaatgggaagcatgaacataatatccttagatgacttaattaggcagctgaataaagacatggagaagcttaagttgtacggaaggaaaaaaagttgccaagctgatgatgttgaggactacctgtctaaaatgcttgaacatgatatttatgatagacatccagacatgaactgcatgtgggatttaggttggaatgatgagacagttgcatttatcgagaaatatgatgttataagggatacagaaaagcatatccttagtcttcttctggatgagatcaccgtagatttttgcatgtga

SEQ ID NO: 2958 - DNA, 1662 bp, Glycine Max
atgctgaatggaagtaggtatgtcctccctcgcagcattcacatactctttttttctcaacatgtgaggttctttggtcatttgcatccccctaaatttcacactgtagacgatacccttctttccttcaatcgcatgctccgaaagcaccctcccccacccattttcgtattcgacaagcttctgggagccattgtaaggatgggtcattaccccaccgccatttccctcttctcccaacttcactcaaagggaatcaccccttccatcgccactctcaccatcttgatcaattgctactgccaccaggctcacctctctttcgccttctctcttctgggaaccattctcaagatggggtttcagcccaacatggtcactttcaacactctcatcaacggtttctgcatcaatggtatggtctctaaagctatggcctttcgcctcgaccttatggcaaaagggtatcctttggatgagttctcatatggctctttgatcaatggcctgtgtaaaaatggacaaactagagatgcccttcaattgctgcaaaagatggaagaggatttggttcggcctaatctcattacctatagcacagtcattgatgggctgtgcaaagatagacttatagccgatgccctccgtttgttttctctggtcacttcaagggggattttggttgatgttgtcgcctacaattctctcatccatggctgttgtagtgtcggtcaatggcgagaagcaactcgattgctaactatgatggtgcgggggaacatcaacccagatgattatacctttaacatattggttgatgcgttgtgtaaagaaggaaggattgtggaagctcaaggcgtgttcgctgtgatgatgaaaagaggcgagaagcctgacattgttacttacaatgccttgatggaagggttttgtttaagcaataatgttagtgaggcaagagaactattcaacaggatggtcaaaagaggcttggaacctgatgtcttgaattataatgtcttgattaatggttattgcaagattgacatggtagatgaagccatggttctctttaaagagatacgttgtaaaaatttagtccctaatcttgctacttataattctcttattgatggcttatgcaaattggggagaatgtcatgtgtgcaggagcttgttgatgaaatgtgtgataggggccaatcccctgatatagtcacttacaacatttttttagatgctttttgcaaaagcaaaccttatgagaaggcaatctcattatttcgacaaattgtccaaggaatttggcctgatttttacatgtatgatgtgattgtagaaaatttctgcaaaggtgaaaaattaaagattgcagaagaagctcttcaacatcttttgatacatggctgttgtccaaatgtccgaacgtataccattatgatcaatgccctttgtaaagactgctcttttgatgaagctatgaccttgctttcaaaaatggatgacaatgattgcccccctgatgctgtcacttttgaaacaattattggtgctctccaagaaagaaatgagactgataaggcagagaaacttcgtctggaaatgattgaaagaggtcttgtaaacgatgaagcaaggtctgataatttagttccatgttag

SEQ ID NO: 2959 - DNA, 267 bp, Glycine Max
atgctgatgacctttttcaaaggcgtagaaattaatatttggtcgtctaataaaatcaaccttctgcatccacatctgaaccaaaatgggcatgtggcatctcaccacactgagtttcgaaataaactgttgggtattccatgtgccatatgtgcttggagcagtgataattgtgtgcggtctatacacggtgctttggggtacagcccaagaattgaaaaagaagtctcagttagtgccattaggaaacaccagaggagagtctga

SEQ ID NO: 2960 - DNA, 1329 bp, Glycine Max
atgctgccactcctaggatccaacatggctcaaacactaaactgcagaacactacaaccaatggactcaactatgatcaagtcactgtcccacaatccaaaaaacgccaattccaccgcattcacaaggcactttgccaaaaaatctggtgtttttatcaagatcatggcttctgctacacccacagcagctcctatcacctttggattcaagaatttgttggaaacattcactgttgatgtgcatagagcagagaacaggccactgaatgtgcccttaatagccccttttaccattgctacctctagattggccaaggtggagaacgtggccataagggttgagttgagcaatggttctgtggggtggggcgaggcaccaattttgccttttgttactgcagaggaccagaccactgccatggccaaggcttctgaggcatgtgccttcttgaggagatgtcctgcactcactttgggttccatgttgggggagattgctggtattcttccagggcatcaatttgcttcagttagggctgggatggagatggcaataattgatgctgttgcaaatagtattcgtgtgccattgtggaggctttttggtggggcttcaaataccataaccactgatattacaatcccaattgtttctccagctgaagcagctgaattggcttctaagtactataaagaaggatttaagactttaaagctgaaagtgggcaagaatctgaatgcagatatagaagtgcttcaagctatacgtgttgcacaccctgagtgtcagtttattcttgatgctaatgaggggtataactctgaggaagcagttgaagttcttgagaaactacatgatatgaggttgactcctgttctatttgagcaaccagttcatagagatgattgggatggtcttcggtatgtcggtaatatagcaagagagagatatggagtatctgttgcagctgatgagagttgcagaagcatagttgatgtttacaaaattgtggaagggaatgttttagatgtcattaacataaagcttgccaaagttggggttatgggtgcccttgaaattattgagaaggcaaaagcagcaggtttagatttgatgattggtggtatggttgagactagacttgctatgggttttgctggccaacttgctgctggccttggctgttttaagttcattgacttagacacaccacttctgttgtcagatgatccagttcttgaaggctatgaagtttctggtgccacttataagttcacaaacgctaggggacatggtggattccttcactgggacaaccttgcttat

SEQ ID NO: 2961 - DNA, 1950 bp, Glycine Max
atgctgcctcagaagcacactctggtggcgacactggctgtggtgctcgcagtagcacaagcagtagatctggcttccgagcgagccgcattgctcgctctccgttccgccgtgggaggccgaaccctcttctggaacgccaccagggagagcccctgcaattgggccggggtccaatgcgagcacgaccacgtcgtcgagcttcacctccccggtgtcgctctctccggcgaaatcccggtcggtatattcgggaatctgacccagctccgaacccttagtctccgtttcaacgcactccgaggttccctcccttcagatctggcctcctgcgtcaacctccgcaacctctacattcagcgcaacttgctcagcggccaaatcccaccctttctgtttgattttgcggacctggttcgcttgaacttgggcttcaacaacttctccgggccctttcccaccgccttcaacagcctcacccgcttgaaaactttgtttctcgaaaacaaccagctctccggcccaatccccgacctggacaaactcaccctcgaccagttcaacgtctccgacaacctcctcaacggctctgtccctcttaagcttcaggcattccctccggactcttttctaggtaactccctctgtggccgcccactctctctctgtcccggagatgttgccgatcctctctccgtcgacaacaacgccaaggacagcaacaccaacaacaagagcaagttgtccgggggcgccatagcgggaattgttgtcggatcggtggtgtttcttctcttgcttgtgttcctcttcattttcctgtgcaggaacaagagtgccaagaataccagcgccgtcgacattgccactgtcaaacatcctgagacggagtccaaagttcttgccgacaagggggtctccgatgtcgagaacggcgctggtcatgctaatggcaactctgcggtcgcagctgtggcggtggggaatggcggtagcaaggcggcggaagggaacgcgaagaagttggtgttttttgggaatgcggcgagggcgtttgatttggaagatttgcttagggcttcggcggaggttttggggaaagggactttcgggacggcgtacaaggcggtgttggaggcggggccggtggtggccgtgaagaggttgaaggacgtgaccatttcggagaaggaatttagggagaagattgaggcggtgggagcgatggatcacgagagtttggtgcctctcagggcttactatttcagcagggatgagaagctcctcgtctatgattacatgtccatgggaagcttgtctgcgcttttacatggaaacaaaggagctggtaggacaccactgaattgggaagtgagatcaggcattgcacttggagctgcccgtggcattgagtacctacattcacgagggcctaatgtttctcatggaaatatcaagtcatcaaacatcctcttaaccaaatcatatgatgccagagtgtctgactttggccttgcacaccttgttagcccctcctctacccctaaccgtgtggccggctaccgtgcaccggaggtgactgatcctcgcaaggtgtctcagaaggtagatgtgtacagttttggtgtgttgctcttggaacttctgactgggaaggcacctacccatgctctcctgaatgaggaaggagtggacctccccagatgggttcaatctgtggttagagaagagtggacttctgaggtctttgatcttgagctccttaggtatcagaatgtggaagaggagatggttcagttgttgcaacttgcagtagattgtgcagcacaataccctgacatgcgcccttcaatgtctgaagtggtaaggcgcatacaagagttgcgaaggtctagcttgaaagaggaggaccaggaccaaatccaacatgacaatgatatacagttatag

SEQ ID NO: 2962 - DNA, 204 bp, Glycine Max
atgctgcctttgttcttctcagtggctttctctgctgtgcctctgatcctctatattccaccactcagaagcttgaacctctttgttgaaaccattgaagacatggcaagagagtcaagaatccacaccaacaggatctacccgcgcctgcgtgtggcttggtcaagggtcatgaattgtatactgtgcaacagaacaaggtag

SEQ ID NO: 2963 - DNA, 828 bp, Glycine Max; identical to SEQ ID NO: 283

SEQ ID NO: 2964 - DNA, 1137 bp, Glycine Max
atgctgggaactgcactgcaattcagcggcgttcgcggcgaggatcggttttacattccggtgaaggcgaggaagaaccagaatcagcggaaacagagtcacagagccaagaacaacgaacctgaaaacgcggatttagcttcgaagaacaaagtcgatgtctctgaaaatagcaataacaatagcaacatcaaaagcaagagcgatagtaatctcaaccaatctctgaaaccaactctttctccgtccgtagaggctgtcagtaatatcgataggttcttggagtttacaacaccgtcagttcctgctcagtatttctccaagacaacgatgagaggatggaagttttgcgatgtggagtatcagtcttactttacattgagtgatctgtgggagtcttttaaggagtggagtgcgtatggagctggagtgcctttggtgcttgaccaaagtgattctgttgttcagtattatgttccctatttgtcagctattcaactctatgctcactctgctgagaagtcaagtgcaaagccaagtgaaggaagtagtgattatgaatatggaaaaaggactgaatttatgacacaaagaagtagtcagcatctaacaggtgtacagtgcaagaaggattttcaagtgatgatagtgaaactgggaatcctcaagatctactattcgagtattttgaacaagatcctccttatagtcatacaagatcttgcacgccactatcctaccattaagtcattgagaagctgtgatttattaccagtcagttgggtgtctgtggcatggtatcctatatatcgaatacccacaggtccaactttaaaagatttagatgggtgctttctaacgtaccatacactccatacacccttgacaggaagtggtcgtactcatgctccaacactggtttatcccagtcagatggatgttgtaccaaagatttctatgcctacttttgcaatggcttcctataagttaaaggggtctatttggatgaaaaaaggagttagtgaatctcaacaagtgagttccctcttgcaggctgccgataactggttaaggctagttcaggttcatcacccggattttcagttctttaaatcacatggcacataccatagatga

SEQ ID NO: 2965 - DNA, 1308 bp, Glycine Max
atgctgggatgttactgccaacccaacaacaagcctcttcatggttgtgttcttgtggggaaagataactcttcaacctctaatggagctttagccgaaccagttgattacaaattggtatggaacaccaagtctcaaaaaataaagcaagacggacatggctacatttggttaccaatatcccctgatggctataatcctgttggccatgttgtcaccacctcaccagagaagccttcccttgacaaaatcaggtgtgttagatcagacctaactgatgaatccacaacatgccattcaatgaagctttggagaacagaaaacaagaggttcaatgtgtatgatgttaggccaatcaagagaggcattgaagctcaaggggttagtgtaggaaccttcctagctcaaagtggaggagggacaaattccaaagcttttcctattttttgtttgaaaaataccaagggtagcttttcttacatgcccaatttatcccaaattaaggcaatgatcaaggcttattctccatacatgtacttgcatcctatggaagagtacctcccttcctctgtggattggtttttcaccaatggggcagtactaattgagaaaagaaagggtgtcataagggagagttcaatagaaccaaatggtactaaccttccacaaggcagttccaatgattatgatgatgctacctattggttggacctgcctttggatgaaaccaagagagttagtgtcaagaaaggagatttggcaagttcacaagcttatgttcatgttaaaccaatgcttggtggaactttcactgacattgtcatgtgggttttctacccatttaatgggggtgcaagggcaaaagtggcatgcactaacattccactaaggaccaaaggggaacatgtgggagattgggagcatttgacattaaggataagcaacttcaatggagaattatggaaggtttatttctcacaacatagtaagggtcaatgggaggatgcatctgagcttgagttccaaaatggtaatagacctgtggcttattcttcattgcatggccatgccttgttcccaaaacctggcctagttatgcaagggatgagagggttaggtgtaaggaatgatgcagcaaaaagtgatgcagtcatggatatggcaacttggtttgaaattgttgctgctgaatatttggggtcacaaattagagagcccccatggttaaatttttgcatgaattggggtccaaaggaagggcccaagggtccaaagcagaaggatatgtggaaaggagatgaacggtaa

SEQ ID NO: 2966 - DNA, 1548 bp, Glycine Max
atgctgtctgttttgcaggcaaattcacaaaattatccccaagaaaccaaactattcatctcttgcttttcagattattctcgatactcaaacttttcagtctcagaaatcatatacaccccacaaaaccccaaatcattcaactccatcttgaacttacacattcacaacaaaaggttcaaaacacaagccacatcgaagcctctagccatcataactgcccgatctgagaatcacgtgcatgccacggttaaatgtgccaaatcaaacggcattcaagtcagaatccgaagtggtggccatgactatgaaggcctttcatatgtctcagacgtgagttatgtcgtacttgacatgtttcctcttcataagattgatttggacatggaaagtggcacggcatgggttcaggctggtgcaacacttggtgaactttattaccaaatagcaaacaaaagcaatgtgcttgctttcccagcaggggtgtgttcttctttgggaactggtggccacttctcagggggtggttatgggaatttgatgagaaaatatggtctttctgtggataacatcattgatgccatattggtcgacgccaatggtattctcctggatagaaagttaatgggggaggatcttttttgggctataagaggaggtggtggggccagttttggtgtcattgttgcatggaagataaaattggtccctgtgcctccacaagtgactgtgtttagagtgaaaaaatccataaaagaagatgcaacagatgttgcataccaatggcaacttgtggcaccaaatttggacaaagatcttttcataagagtccagcctgatgtggtcaatggaacagttatagtctctttcataggccagtttttgggcccaattgaaaggcttcttcgtttggtgaatgagtcattccctgaattgggtttgaagcaaagtgattgcacagaaatgccttggatcaattccactcttttttggtatgatctcccaattgggactcctattgaagccttgctaccaacaaatcaggagccaccttcaatctacacgaagggcaagtcagattatgtgaaaaaacccatcccaaaggaggctctaaagtccatttgggatttgatgattaaatacaacaacatttggatgcaatggaacccttatggagggagaatggctgagatatctccaaaagcaaccccttttcctcacagggcagggaacttgttcctcattcagtactctgtgttttggactgaagatggtgctgaggccaataatcgttacttgaactattcaagatcgttttatgagttcatgaccccttatgtttcaagctttccaagggaagcgtttctcaattatagagatattgatattggtgctaaaaatccaagcacttcaaataacttggtcgactctctcaaatatgcaagcaagttatttaaggaaaatgtagaaagattactgattgtgaaaacaagggttgatcctagcaatttctttagttatgaacagagtataccaactcagaattga

SEQ ID NO: 2967 - DNA, 960 bp, Glycine Max
atgctgtttctccaaaccactgtcttaactagacgcttctcacctttttgtgatgctactttgcatccattgtcattacttaatgttcaaaatcctatgttggaatgtgctcacagtttttctcattattcccctgtacctagcaaccgcactgtaaagtctatatcatgctctgtttctagaaagtcccattcaaaacctgagcctgaaccacccgaacctgaagctaattcgaaccaaagagcagggcctaaggcgagaagcagaagtcaccaacctaaagatgtggaatccagtaacgacgataaaagttcagcagagacattccccacaacgattcccaggaagccgaggcgtggtcgtagaagtgaagcagtggcagtggaagattttgagagggatggcgtaagaaataagatggtgattgaggaagagagtaaaaactggccattggatgcagatgttgggtggggaataagagcttctgagtattttgagaagcatccaatcaagaatgtggtgggagaagatgggtatgaaattgactgggaaggggagattgatgacaactgggtgcaagagatcaactgtttggaatgggagagttttgctttccatcccagccctttaattgtccttgtctttgaacgctataacagggcatctgataactggaaaaatttgaaagagctggagaaagcagtaaaggtattttggagtgcaaaagatcggttgcctccccgggcggttaagatagatatctatatcgagagagatttggcatacgccctgaaagttagagaatgtcctcaaattttatttttacggggtaacagggtcgtgtacagggaaaaagaactcagaactgcggatgagctggttcagatgattgcatttttctattataatgcaaaaaagcctgcgtggatagatgataaggccctgtattttcgtttttaa

SEQ ID NO: 2968 - DNA, 1116 bp, Glycine Max; identical to SEQ ID NO: 284

SEQ ID NO: 2969 - DNA, 657 bp, Glycine Max
atgcttcataggttaagcagacgctgcttttgcacctttactccacgcccttggcttttcgtgggcttgggcaaccctggcgacaagttcaaaggaaccagacacaatgttggctttgagatgattgatgcatttgcggagtcacaggggattcctatggacactgttcactccaaagctatttttggaaaaggttttgttggtgaagttcctgttttccttgcaaagcctcaaacttacatgaatctcagtggtgaatcgacaggaccactggctgcttattataagctacctcttaatcaagtgcttgtgttccatgatgacatgaacttgccctgtggggtgcttcgtcttcacgacaaagggggtcatggaagtcacaaagggctgaagagtgtgatctataacttcagaggaaatagagaatttcctaggctgagaattgggattgggagtcctcctgggcaaatggatcctaaagcatttttgcttcaaaagtttaatgtaacagctaggcaacgaattgatgaggctttgcaagaggggattgatgccttgaagctccttttatctaaaggtttgacagagagtgcaaaaagattcaataaagaacaaaagtataagcacttaagagtgcagaatttaccagtttcatag

SEQ ID NO: 2970 - DNA, 1509 bp, Glycine Max; identical to SEQ ID NO: 285

SEQ ID NO: 2971 - DNA, 1203 bp, Glycine Max
atgcttccatttctttctcaaagtttcaacactctttgtttgtcctcagcttctgaactcaaccaagacaaagccatgcatgaaacaaatatgatgaaggccaattctaacttgcataaaagaaagtctagcttgattagtggtggacatccttctgcattcaagaagaggatatcaagaaggggaagctatgaggattctcttgaagttgaaagaaagcagctagaggataattttactacagaagacaattataatgagaatgaggataagaatgatgttggtgacaacacggatgcagaaaaagcaagagatgatgatgatgtagtggatgaccatcaagaggaagcagagtacttaccagagggtgatggtccaactgctacagaggagcaacaccacaaaggtttggtcacaaaagatgcaaatgaaaagaataagccttctacacgacatttcatccatggatatcacttgatccaaggacagatgaatcatggaatggaagaccatatttttgctcaacacaggaatctcgacggttatgacttagggttgtatgcaatatttgatggtcactccggtcatgaagttgcaaaatacttgcaaagtcatctgttcgaaaatatactgagtgagcctgaattctgggaaaatccagtgcatgctgttaagaaagcatgtaaagccacggatgatgagattttagaaaacatagctgattcacgtggaggatcaacagctgttgcagcaatactaattaatggagtaaagctactggtagccaacattggtgattctcgagcaatatcgtgcaaaaatggtcgagcaaaaccacttactgtggatcatgaaccagagaaggaaaaagatcttattgagagtagaggaggttttgtgtctaagaagccagggaatgttcccagagtggatggccaattagaaatgacacgagcatttggagatggaaaactgaaggagcacattacggcagaaccagatgtgacgattcggaagattgatgaagacactgaattcatcattttggcaagtgatggcctatggaaggtgatgacaaatcaggaggcttgtgactgtatcagggatgaggatgatgcgcaaaaagcatccaagaagttagtcaaagaagctaaatctcagggaagctatgatgatatttcatgcatagttattatattctag

SEQ ID NO: 2972 - DNA, 1653 bp, Glycine Max; identical to SEQ ID NO: 286

SEQ ID NO: 2973 - DNA, 444 bp, Glycine Max
atgcttcccgagtgtttggctcgttcctcctctgattgcgtcttgctttgtgtcgtcaaaggtggtagccaccgccctgctgtgagcccttttcttatagtctgccacttccctcggatgaatgggaggccatcctcttgtcaaatttgggagttgacaaagtttgatagagtgcaattttggagcaacatctatgatttttcaatcgatgaattaggcatctatccacacttcttttacagcgtgggcggcgtcatgattagaaacagaagagggtcactgctgataattgttcaggggcaattagtctattccttagaccttgagacacagatccttatacaacttccaattgcagaggggggtttatggactctataccctgcttattacgctgagagcctgtttctacttgacaaggtagatgatattttgtcctattga

SEQ ID NO: 2974 - DNA, 60 bp, Glycine Max
atgcttcgaagaataccctctttctctcgttttcgtcgtcttcatcacatgatggattga

SEQ ID NO: 2975 - DNA, 1266 bp, Glycine Max; identical to SEQ ID NO: 287

SEQ ID NO: 2976 - DNA, 249 bp, Glycine Max; identical to SEQ ID NO: 288

SEQ ID NO: 2977 - DNA, 1167 bp, Glycine Max
atgcttgatcaggtccaacaccctacaatcatggacaaggttgctggccagctccatctccgttctggtgtttctggtattaggagttatgaaggagcctactgccaccccacaatgtaccaaagaccctcttttgggaattactcgaatgctgcattgcagtatcctgtgatgccctcatgcaaagctactatggatttgtctgctgctgcaacaactgcctcccccgtctttgttgctgctccagcagagaaaggccattttcttatagactttctcatgggaggtgtttcagcagctgtctcaaaaactgctgctgctcccattgaacgtgttaagcttttgatccagaaccaggatgagatgatcaaaactggtagactttctgagccctacaagggtattggtgattgctttaagagaacaatggcagatgagggtgttgtttctctatggagaggaaacactgcaaatgtcatccgttatttccctacccaggctttgaactttgcattcaaggactacttcaagaggctttttaactttaagaaggatagggatggctactggaaatggtttgctggcaacttggcctctggtggtgctgctggtgcttcatcccttttgtttgtttactctcttgactatgcccgtacccgtcttgccaatgatgctaaggctgcaaagaagggaggagagagacagttcaatggccttgttgatgtctacaggaagacattggcatctgatggtgttgctgggctctaccgtggtttcaacatctcatgtgttggaatcattgtgtatcgtggtctgtactttggattgtatgattccgtgaaaccagttgtcctcaccggatcattgcaggatagcttttttgccagctttgccctcggatggctcatcaccaatggtgcaggtcttgcatcatacccaattgacactgttagaagaagaatgatgatgacctctggtgaagctgtcaagtacaagagttccttggacgcattcacacagatcctcaagaatgagggcgccaagtccttgttcaagggtgccggtgctaacatcctccgtgccgttgctggtgctggtgtgcttgctggttacgacaagttgcaggttcttgtgttcggcaagaagtatggttctggtggtgcttaa

SEQ ID NO: 2978 - DNA, 1869 bp, Glycine Max
atgcttggaaacgtagggaaagttgcccaatctattcttagaacccatagaagaagatatttggaagcaagtagaaatgaggcttttacctcagttggaccaaatatcaagcaatgcaggatgtacatgcaatataagtttccaattgaaggatgtaattcattcttgtggcactggacaagagaaaactttcacaaaggctgttcttttaggaacttctctgtaacttctgcaagaaatgtagcagcatataattctcgaatagcttggaagttgctgtacaaaaaatactcttccaatggttataatggatttacctccataaatatgattgctcaagcagtgagcctggctttgactcgttcttatttgctggttcctggttttttagcatttgctagtggaaagctagcattggctcagcaaaatggggcagacacagaattttacccatcacagaatgcattgtatatgcatgcacaagatgggtatggttacatgtttgcatttgtattcattgtagtggaaagccttgttttgttagtgagagctatctatctggccatattattctctccaagcatactgatggcgccacttgcagattattttggaccagaattcaggaaaatgtggctatcggttgttcatcgtacactagaaaaagcaggtccagcattcataaaatggggtcagtgggctgctacccggcctgatctgtttcctcgagatctatgtactaagcttgccgaacttcagacgaaagcacctcaacatagttttagctacacaaagaaaactattgaaagagcgtttggtcgaaaaatttctgagatttttgagaattttgaagaagtgcctgttgcatctggaagtattgcccaagtgcatcgtgcttctctaaaatatcgttaccctgggcagcaagcaaaacccctggtggttgctgtaaaagttagacatcctggtgtcggagaatctatcagaagggattttgctattatcaatttggtggcaaaatcttcaaagttcatccatgctcttaattggttaaggttggatgaaagtgttcaacagtttgcagttttcatgatgtctcaagttgaccttgcacgggaagctgctcacttgagccgcttcatttacaatttccgtcgatcgagggatgtctcttttcctaagcctgtctatccacttgtgcatcctgcagttttggtggaaacctatgaaaatggagaaagtgtatcacattatgtagatgagcttcaaggacatgaaaggattaaaagtgctcttgctcacattggtactaatgcacttttgaagatgcttctggtggacaacttcattcatgcagacatgcatcctggaaatatccttgtacggagcaagcctcacaaacgacttttcaaatcaaagccgcatgtaattttccttgacgtaggcatgactgctgaactctctggcagtgatcgggtaaatttattggaatttttcaaagctgttgctcaccgagatggtcggacagctgcagagtgcacactcaggttatcaaagcaacagaactgtccaaatccaaaggcctttgttgaggaaatggaagagtcgtttactttttggggtactccagaaggtgatctggtccatcctgccgagtgcatggagcaattgcttgagaaagttaggcgtcataaagttaatgttgatggcaatgtttgtactgtcttggtcaccaccttggttcttgagggttggcagcgcaagcttgatcctgggtatgatgtgatgaatactctgcagacattgctgcttagagctgattgggcaaagtctctttcatacacaattgatgggctcatggccccttga

SEQ ID NO: 2979 - DNA, 1317 bp, Glycine Max
atgcttgtttttctattttgtttcttactgctatgttcactttctactgcctccttcgctgaagccacacaaactctaagcggcttcagcgttgatcttattcatcgtgactcaccattgtcacccttctacaacccttcgctcaccccatcagagcgcctaagaaatgctgccatcgcgtttggatcgagcaatgaagataaagatgagtcccctaaaactattacatttccagacacacccattggcgaatacctaatgagattttacattggtacccctcccgtggaaatgtttgccactgcagacacagggagtgatctcatttggatgcaatgttccccttgtaagaaatgttcaccccaaaacacccctttgtttgaaccaagaaagttttcaacgttcagaaccgtgtcttgtgactcacaacctcgcacactactctcccaatcccaacgtacttgcacaaaatcaggtgagtgccagtactcttatgcatatggtgacaagacattcaccgttggaacattgggtgttgataaaattaattttggttcaaagggtgttgttcaatttcccaaattcactgttgggtgtgcatattacaatcaggataccccaaattcaaagggtcttggagaaggaccattatccctagtttcacaactaggtgatcaaataggttacaaattttcctattgtttgatcccctacggtttaaactacactagcaaattgaaatttggggacatagcattagcaacgataaaaggaaaaagggttgtgtccacacccctcatactcaaatcttctgaaccaagtttttactatgtcaattttgaaggcatcagcattggaaaaaggaaggtggagatgagtaaaagtgaaagtgatggcaacatgttcattggttcaggggccacgtacacgatgttgcagcaagatttttacaataagtttgtgactttggtgaaggaagtcgctggtgctgaggtggagaaaaatcctccagcaccattcgatttttgtttaagagataagggtactaagcacctttggttcaaggatagcagtgatgacgacgacgatggtgtgcctgatgttgtgtttcattttacgggtgctgaggttcgactggatttttttactcacatgttttcattggtcaatgacaacttgtattgcatgttggtacaccccagcaacggagatggatttaacatcttcgggaatgtgcaacaaatgggatttcaggtggagtatgatcttagagggggaaaggtttcgtttgctcctgctgattgtgccaaacattag

SEQ ID NO: 2980 - DNA, 1110 bp, Glycine Max
atgctttctgtgagggatttttggaggcggcataggaggaaggttttcgtcactgttggtgttttaggaagtgggtatcttttgtataagctctacggtgctcagagacatggggttcaggaacttgaaagagaactcgcagttcagagggaaactgaggaccttatgaaggctcagatgcaagctcactttgagaatattcagaagatgtctgatgtaacattgccgcatgctatgcacgagttaagttgtcggatcacagaagagttggatctttctcaccttcttgaaaggctaattcaaggaaagggtcagccaaacaccttgactcaatcagagaaactagatctatggagtagactcaaaattctgagttttacaagaatgacattgtcagtatgggctacaacaatgcttagcttatatacaaaagttcaagtcaatattctaggaaggcatttatacattgatacagcacgtagtctcggaatctctgattcagtggaaagtggagatgtggttgatagggaagaccaaaagaaatttctagataatattgattttctctctcagcatggtatgcctgccttgatttctgatatggaggcagcaacaaaagaagttctcaaaggaaagcagttgagtactttcttcaacagcacaacacttcatgaaactatcatgcagatactcaactccttcatgagcatggggactccaaattcctggataaagtatatgatacctgaagatgttagaccatattccacaacctatggtagtgatgacccagtgccatttgacatgactgaatttgaacaacttatgatggaagcatgggcagtattatcaagtgctgaatttggaagcattgtagagatatctctgaaagcagtggtggatacactggtggagctcatggggactaaatttagtggaggaagtgtagccgggggcctgcctctggccagagtgttgcctcaagttgcacagatgtgtcctttgctccttgaagaacccagaaaaaatcagttcatccaaatcattaaaaatatacaggaggttgaactttttttcacactcctctatgcaaatatgccacatgcatag

SEQ ID NO: 2981 - DNA, 1008 bp, Glycine Max
atgcttttagctgtgattgatctctttcattatattcgtctttatatttttctctcaattttctttcatctctatatttctctagtcatttttagtcttcagaaagtaggactatgcaggtgggttctcttagaatcactattttttacaatttatatggttcttgcagctggaattgtactctttcttcttgtggagaagttagtgaggtatgttgaagaaaactcaggaagagctaattcatggacacatggacaccaccaccatcaccacaatagcaaggaaaaattgaaagatgataacagttctactgccaactttcagtcagaatctaataatgcaaaagaagagagattgatagatgagagaaaagaagacgatcaagtgtcacttgactccttgaagggagataatccatctcaatctgaaagctcactcagaaagagaattggaagcaatgtgaccaaaggtgataatctcgacgataatactgtagatagtgccacatataatgtaaaatcttcaaatgttaaggaaccagttagatcaccaacaagtcttgtgtttggttatctcaatcttttctctgatggagtgcataacttcaccgatggaatggctttaggaagtgcattcttgctttatggatctgttggtggctggtctagaactatgtttttgctggcacatgagcttcctcaagagattggtgattttggcattctgataagatctggtttcagcataccaaaagcgttgttcttcaactttctgtcagcactagtggcacttgcggggactgcattggctctgctgtgggggaaagatcctggacagtcatctttgattgagggatttacagcaggtggatttatatacattgcaattgcgggagtacttgcagaaatgaataacggtgggaatacaacattaagaagtactgttgtccaaataatctccctgaccattggcatggctgttgcccttggtatttcccttgtagaatga

SEQ ID NO: 2982 - DNA, 1248 bp, Glycine Max
atgcttttggattggaaggttgttgcaatggggaaggttgtgttgttgtttctttgcatggtattggtggtggtgcctttggcttgtactgattcaattcagaagcttgaggttcagaagcacttgaagaacttgaataggcctcctgttaggtccatcaagagtcctgatggagatgttattgattgcatccatgttacacaccagccagcttttgatcaccctgacctcaaaaatcacaagattcagatgaaaccaaatttccatccagaagggcatccttttggagaaagcaaagtctcttcaaattcaaagcctattactcagctgtggcaccaaaatgggaggtgccctgaaggaacaattccggtccgaaggacgaaaaaggatgacatattaagaacaagctctgttcagcattttggaaagaagaagcaaagtagcttccctcagccaaaacctgcaaaacctctacctgacatcatcagtcagagtggccaccagcatgccatagtgtatgtggagggagataagtattatggagccaaggcaaccataaacgtttgggacccaaaaattcaacaacccaatgaatttagcctttctcaaatgtggattttgggtggctcttttggtcaagatctcaacagcattgaagcaggttggcaggtcagccctgatttgtatggagacaacaacactagactcttcacttattggacaagtgatgcatatcaagctactggttgttataatctcctttgctctggctttattcaaattaacagtgatatagccctgggagcaagcatctccccactttctaagtatagctcttcccaatatgatatcagcatcctggtctggaaggaccccaaagagggtaactggtggatgcagtttggtaatgatcatgttatgggatactggccggctcctctattctcgtacctctccgacagtgcgtcaatgattgagtgggggggagaggtcgtgaactccgagtccgacggccaacacacctcgactcaaatggggagtggccatttccctgaggaaggttttggcaaggctagttacttcaagaacattcagattgttgatggtgacaacaagcttagagctccaaaagaccttggcacttacactgagcaagatagctgctacaatgttcaaactggtagtgctggagattggggtaactacttctactatggtggtcctggtagaaatccaaattgcccttga

SEQ ID NO: 2983 - DNA, 441 bp, Glycine Max
atgcttttgttgggaggagcattagcatgttatggaattctattatgcttgaaaatgagcagagtgagagccgagaaaccttcatctgaaatgtggaaggttgcaggtttaactattgtctctgtactatgcttcacatcaagttcctgtgtagaacttttaaccgatatccctatgcagtataactggcatctgcggcgtctgaatgatgtttactcctcgcttttactcattttgtattattttgtgggttcatcaataccttcagcattggtactgtgggtaatgagagaattaccacctgaagaagctgctagcatatctgaagaatcaagtacaatagcttttgttgctgatagttcaattgcaatccatcatcctcaacgctggactacagcaacaagcatgcagaatcagacatcaagagcgagtcctatatga

SEQ ID NO: 2984 - DNA, 429 bp, Glycine Max
atgcttttgttgggaggagcattagcatgttatggaattctattatgcttgaaaatgagcagagtgagagccgagaaaccttcatctgaaatgtggaaggttgcaggtttaactattgtctctgtactatgcttcacatcaagttcctgtgtagaacttttaaccgatatccctatgcagtataactggcatctgcggcgtctgaatgatgtttactcctcgcttttactcattttgtattattttgtgggttcatcaataccttcagcattggtactgtgggtaatgagagaattaccacctgaagaagctgctagcatatctgaagaatcaagtacaatagcttttgttgctgatagttcaattgcaatccatcatcctcaacgctggactacagcaacaagcatgcagaatcaggcagcactttaa

SEQ ID NO: 2985 - DNA, 2256 bp, Glycine Max
atggaaaaagaggaggaggagcagcgcgagtggaggctatacgaaggctacaatgagctccacgcgctggcccaggacttgcacacgcccttcgacgcccccgccgtcttggtcgtcggccaccagaccgacggcaagagcgccctagtcgaggccctgatgggcttccagttcaaccacgtcggcggcggcaccaaaacccgccgccccatcaccctccacatgaaatacgaccctcaatgcgagtccccttcctgccacctcgtctccgactccgacccttctctttcccaccataaatccctcccccaaatccaggcatatattgaagcggaaaatgcgaggttggagcaggacacgagccaattctctgccaaagaaatcatcatcaaagttgaatacaagtactgccccaacctcaccatcatcgacactcccggcctcatcgcgccggctccgggccggaagaaccgtgctctgcaggcgcaggcgcgtgccgtggagtcgctggtgcgggaaaagatgcagcacaaggagttcatcatcctctgccttgaagattgcagcgactggagcaacgccaccacgaggcgcgtcgtcatgcaggtcgatcccgaattggccaggacagtcatcgtgtccaccaagctggacaccaggattcctcagtttgcacgtccttctgatgttgaggtcttcctctcgccgccgccgtcgacgctcgacggctgcattcttggtgattctccgttcttcacgtccgtgccttctggaagagttgggtgtggaagtggttatctccatagctccaatgatgagttcaaacaggcggtttgcttcagagagatagaagatgttgcatctttggaggagaagttgggcagggcattgtcaaagcaggaaaggagtaggataggcgtgagcaaacttaggctgtttctggaagaattgctacaaaagaggtatataaataatgtaccattgatcattccacttctcgagaaggagtaccggagtgtgacaaggaaattaagtgacattaatcaagaattgagcacacttgatgaagccaaactgaaggagaaaggaagagccttccatgatatgttcttgaccaagttgtcattgttgcttaaagggacagttgttgcacctcctgataagtttggtgaaacactgcaagacgaacgaattaatggaggtgcatttattggtgctgatggtgttcagttccctcacaagctaatacctaatgcagggatgcgtctttatggtggtgcacaatatcatcgggcaatggctgaatttcgttttttggttggaggaatcaagtgtcccccaattactcgggaagaaattgtaaacgcatgtggagttgaagacattcatgatggaacaaactactctaggactgcttgtgtaattgctgttgcgaaggctcgtgacacatttgaaccttttcttcatcagttggggtccagactgttgtatatactcaagagattgcttccgatctctgtttttcttcttcagaaagatagtgaatatctaagtggccatgaggtgttcctcaggcgtgttgcctctgccttcaacaactttgcagaatctactgaaaaatcatgccgtgaaaaatgtatggaggacttggtaagcaccacaagatatgtttcatggtctctccacaataagagtcgggctgggttacgtcagttcttagattcatttggtggaacagaacattccaatgcttgtaataatcctacagcaactgttctatcacaaacaagtgcacatgagaaagaagacacaaagtcacaaccggatgtaaaactcagccatgtggcctctggcactgattctagttcatccattcagacaacagaaacaaagcttgctgatcttctagatagtacactctggaataggcggcttgcaccttcatctgaaagaattgtttatggcttggtacaacagatatttcatggcattagagaatatttcttggtttccacagaattaaagttcaattgtttccttttgatgcccattgtggacaaattgcctgctcttctccgggaagacctagaatctgcttttcaagatgacctggataatgtttttgacataaccaatctgcagcactcatttgggcagcaaaagagagagacagaaattgaactgaaaaggatcaagaggctcaaagagaaatttagaatgatacatgagcagctaattcaaaatcaaaccatgtga

SEQ ID NO: 2986 - DNA, 1923 bp, Glycine Max
atggaaaaagaggaggaggagcagcgcgagtggaggctatacgaaggctacaatgagctccacgcgctggcccaggacttgcacacgcccttcgacgcccccgccgtcttggtcgtcggccaccagaccgacggcaagagcgccctagtcgaggccctgatgggcttccagttcaaccacgtcggcggcggcaccaaaacccgccgccccatcaccctccacatgaaatacgaccctcaatgcgagtccccttcctgccacctcgtctccgactccgacccttctctttcccaccataaatccctcccccaaatccaggcatatattgaagcggaaaatgcgaggttggagcaggacacgagccaattctctgccaaagaaatcatcatcaaagttgaatacaagtactgccccaacctcaccatcatcgacactcccggcctcatcgcgccggctccgggccggaagaaccgtgctctgcaggcgcaggcgcgtgccgtggagtcgctggtgcgggaaaagatgcagcacaaggagttcatcatcctctgccttgaagattgcagcgactggagcaacgccaccacgaggcgcgtcgtcatgcaggtcgatcccgaattggccaggacagtcatcgtgtccaccaagctggacaccaggattcctcagtttgcacgtccttctgatgttgaggtcttcctctcgccgccgccgtcgacgctcgacggctgcattcttggtgattctccgttcttcacgtccgtgccttctggaagagttgggtgtggaagtggttatctccatagctccaatgatgagttcaaacaggcggtttgcttcagagagatagaagatgttgcatctttggaggagaagttgggcagggcattgtcaaagcaggaaaggagtaggataggcgtgagcaaacttaggctgtttctggaagaattgctacaaaagaggtatataaataatgtaccattgatcattccacttctcgagaaggagtaccggagtgtgacaaggaaattaagtgacattaatcaagaattgagcacacttgatgaagccaaactgaaggagaaaggaagagccttccatgatatgttcttgaccaagttgtcattgttgcttaaagggacagttgttgcacctcctgataagtttggtgaaacactgcaagacgaacgaattaatggaggtgcatttattggtgctgatggtgttcagttccctcacaagctaatacctaatgcagggatgcgtctttatggtggtgcacaatatcatcgggcaatggctgaatttcgttttttggttggaggaatcaagtgtcccccaattactcgggaagaaattgtaaacgcatgtggagttgaagacattcatgatggaacaaactactctaggactgcttgtgtaattgctgttgcgaaggctcgtgacacatttgaaccttttcttcatcagttggggtccagactgttgtatatactcaagagattgcttccgatctctgtttttcttcttcagaaagatagtgaatatctaagtggccatgaggtgttcctcaggcgtgttgcctctgccttcaacaactttgcagaatctactgaaaaatcatgccgtgaaaaatgtatggaggacttggtaagcaccacaagatatgtttcatggtctctccacaataagttcaattgtttccttttgatgcccattgtggacaaattgcctgctcttctccgggaagacctagaatctgcttttcaagatgacctggataatgtttttgacataaccaatctgcagcactcatttgggcagcaaaagagagagacagaaattgaactgaaaaggatcaagaggctcaaagagaaatttagaatgatacatgagcagctaattcaaaatcaaaccatgtga

SEQ ID NO: 2987 - DNA, 1620 bp, Glycine Max
atggaaaaatcaaattccctaccatttctttctgttattgttcttcttcttcatgtctctaactctctaactaccccaacaagagagtccattcacgacacttttcttcattgtcttcaaagccacacaacaaaccaaccagatcatgtttcaaacatagtctatgcgcaaaccaacacatcctacacctcagttcttcgagcctttgctagaaatgccaggttcagcgccccctccacgcaaaagccattactcattgtcacacctctcagtgaaaaccaagtacaagccactgtggtgtgcgccaaaagcattggccttcaactcaaaatcagaagtggtggccatgattttgaaggtgtttcatacatctcccaggtaccttttatcatccttgacatgttcaattttcaagatgtcacagtggacgtgcaaaatgagattgctgtgattcaagctggtgcaagtcttggacaagtttattacaggatttgggagaagagtaaagttcatggctttcctgcaggggcttgtcccactgtaggggttggtggccacttgagtggaggagggtatggtaacatgataagaaaatatgggttatctgttgatcatgttgttgatgctaaaattgttgatgtcaaaggtaggattcttgacaaggaatccatgggggaagatcttttctgggcaattagaggaggtggaggagcaagttttggtgtcatcttatcatacacagttaaacttgttccagtgccagaaaatgttacagtttttcaaattgacaagactttggaggaaaatgccaccgatctagttgttcaatggcaaaaggttgccccacacacagatgataggctttacttgaggcttgtcttacaacctgtaagttccaattttgtgaagggaaagaaaaccataagagcttcagttgaggctttgtttctaggagaagctgatgaacttgtcaaattgttggggcaggagtttcctttgctgggactgaaaaaagagctttgtcatgaaatgaggtggattgattctgtggtttggtgggctaattacaacgatggatcctcagttaatgcacttcttgaccgaaatcattactcggtgcattccaacaaaaggaaatctgattatgttcagaccccaatttccaaagatgggtttacatggatatggaaaaagatgattgaattgggaaaagttagcattgttttcaacccttatggagggaaaatgaatgaggtcccttctgatgctactccatttcctcaccgtgcagggaatctttacaagattcagtacactgtgagttggcaagaaccaggtgctgctgtggaaaaaagttttttgagtcagattagagtgctacacaattacatgaccccttttgtgtccaagaatccaaggagtgcatactttaactacagggaccttgatattggtatcaatagccatggtaaggataactttgaagatggaaaagtttatggtatcaagtacttcaataaaaattttgaaaggttggtgaaggttaagagtgccattgatccagaaaactttttctggaatgaacagagcattccaacatatccaagaagcaatgcgtaa

SEQ ID NO: 2988 - DNA, 2070 bp, Glycine Max; identical to SEQ ID NO: 289

SEQ ID NO: 2989 - DNA, 583 bp, Glycine Max
atggaaacaaatgaacaacaacaacaacatgatgaccatagtattattctccaagttcaagaccctatgggttctgggatttggcccatcaacaactaccagaaccttcttcaaatgcatcaaacacccaacacaacaacctcatccacggtcatagtaccaccctcctcctcatcagggttccttggagacatactaggtgttcatcacaacctagaagaagatgaagagccagaagaagagctaggagccatgaaggagatgatgtacaagatcgctgctatgcaacccgtggacatcgaccccgccacgattcgaaaaccaaagagaagaaatgttcgcatcagtgatgacccgcagagcgtggctgcacgccacaggagagagaggatcagcgagaaaatccgaatcctccaaagactcgttcccggtggaaccaaaatggacactgcttcaatgctcgatgaagccattcgatatgttaagttcttgaagagacaaatcaggttgcttcaatctattcctcaaccttcacgtcaaccaccacaatgcattggtgttgccagtactactcctcatgcta

SEQ ID NO: 2990 - DNA, 1329 bp, Glycine Max; identical to SEQ ID NO: 290

SEQ ID NO: 2991 - DNA, 1656 bp, Glycine Max
atggaaacgaggatgttgcggctttcgattcaacgagtgaggaagttgaactttctgaggcctcagatctctgctttgggaaggtcccatttgtcaactgctgctgaaccatcttccagtaagagcaatccacctagggttccaaatcttattgggggcagttttgttgactcaaaagcatcaactgtcattgatgttataaacccggcaacccaagaagttgtttcacaagttcctttgtcgacgcatgaagagtttaaggcagctgtatctgcagcaaaggaagcatttccatcatggcgtaacactccaattacaacacgccaacgtgttatgttgaagcttcaagagcttatacgcagagatatggataaacttgctttgaatgtgaccactgaacaaggaaagacattgaaagatgcacaaggagatgtatttcgtggtttagaggtggtggaacatgcttgtggaatggctactctacaaatgggggagtatgtttccaatgtatcacatggaattgatacttacagcattagagaaccacttggtgtttgcgctggtatttgtcctttcaactttcctgcaatgattcccttgtggatgttccctatggctgttacctgcggtaatacctttgttctaaaaccatcagagaaagacccaggtgcttctgtaatgcttgcagaattggcattggaggctggtttgcctgagggtgtcttaaatatagttcatggaacccatgatattgtgaatgctatttgtgatgatgaaaacatcaaagccatatcttttgttggttcaaatgttgctggaatgcacatatattcaagagcagcagctaaagggaaacgtgttcagtctaacatgggagccaaaaatcatgcgattgtcatgccagatgcaaatgttgatgctactcttaatgctttagttgcttctggttttggtgctgctggacaaaggtgtatggctctcagcacagttgtttttgttggtggctcaaaaccatgggaggataaacttttagagcgtgccaaagctctaaaagtaaatgctggaactgaacctgatacagaccttggtccggtgatcagcaagcaggcaaaggagagaatacacagattagttcaatctggggttgaaagtggtgccagactactgcttgatggaagaaatatagtggtcccaggatatgaatctggcaattttattggtccaaccatcttatcagatatcaatgccaacatggagtgctacaaggttactcactgctctccaatcttaatgaggaaatttttggtccagttcttcttttcatggaggtgtgctgatagcttggaagaagccataaacattatcaacagtaacaagtacggaaatggtgcttctatatttactacatccggtgttgctgcgaggaaatttcagactgagatagaggctggacaggttggcatcaatgtacccattccagttcctttgcccttcttctcatttaccggcaacaaggcatcgtttgccggtgatctcaacttctatggcaaagcaggggttaacttctatacacagatcaagacaataacacagcaatggaaggattcaactggtggtagcaggattaacttggcaatgccaacctctcaaaaataa

SEQ ID NO: 2992 - DNA, 420 bp, Glycine Max; identical to SEQ ID NO: 291

SEQ ID NO: 2993 - DNA, 1428 bp, Glycine Max; identical to SEQ ID NO: 292

SEQ ID NO: 2994 - DNA, 771 bp, Glycine Max
atggaaatgatggcataccagtttactcggttaccttactcggattccctcaaactgctcgaggctgatatacagcatgcaaatgctttggctgctgcaattcccagagccaagggtgggactcttctccaaatgaaattggtttacaaccacttggctcctctctttctgttgttgctacagtggatgaaatgttcttgtacatgctttctacatagatatctcgacctcttccacatagttgtatacaaggtacacgatgatggtagatcaaatgtggcttctcatgggaggaaagcaagcatccgggacttttatgctgttatccttccatctctcgagcggcttcttggtagcttggagaagttggacatttgtaagaaaagtcattctagcatagatggtattagttatggcaagaaaatgatggaaggtgatgggaaactaatcaatatcgatctggaaagagaagatgaatgtggcatatgcttagagccttgcaccaaaatggttttgcctaattgctgtcatgccatgtgtatcaaatgctaccgcaagtggaacacaaggtcagaatcttgtcctttttgccgtggtagcttaaggagagttaattctgaggatctatgggtactcacttgtaatgaagatgttgttgatgctgaaacagtttccaaggaagacttgttgcgtttctacctttatatcaacagcctacctaaagatcaccctgatgcacttttcttaatgtattatgaatacctgatttga

SEQ ID NO: 2995 - DNA, 2229 bp, Glycine Max; identical to SEQ ID NO: 293

SEQ ID NO: 2996 - DNA, 2382 bp, Glycine Max
atggaaattaaaatctgccatcatcttattcttagtgtcctccgtctctgtcatctcaagcattgcttcaatcgctcctcattcatacatattatattcctgtcactttctttcttctcagaacttcgttttccactcacttcctacttcaattcatctttagcctatcctagtttctgtgtctgtcttaagaaaacatggaagcaaacaactctgctatcctttcaaattgtgggaatagtttatggtcaactgagcactgcacctttatatgtatttgggacaatgcaaaagggagatcttgcatcagaagaagtcgtttatgaactattttccttcattttctggacactcacaataatatctttggtcaagtatgcctctatagtgttgaaagcagatgatgaaggagagggtggtattgttgctttatactcactgttgtgtagaaatgcaaaagttgggctgctcccatgcgacaaaagtgccaatgaagttgtgctttatgaagagagaagtggttcaaagctcaaagcagattcaagagcacgaagggccattgagaaacacaagatctgtcactatttaatattgttcttagccctctttggttcctgtatgaccattggggacgcagtgctcactccagcgctttcagagtttaaatttatgtttgatcgaaatgtcatgttcacaccagatgtacctcactgcggtacacgtaaaattgggatcatgtttgctccaatcatcactgcttggttgttgtttgttgctggggtgggaacgtataatgttttccactgggatgtaaaaattatttataaaatatccccagtctacatatacaaattcatcacacatattgacatccacagatggaggttgttagggagcgtcattttatgtgtagcaggatcggaggcaatgtttgcagatctaggccatttctccaagaaatcaattaaggtacagctgcatatatctccaaaaatttacatgctccagattttaatcatcttagtcaatctatgccacatttttcttctctttgttattaccgctatagtaaaacacttgttcatagtattgtccctactttcttcagctgtgggaagccaagcaaccataacagcgtgtttctccatcattaaccagtgtctggcattaaattgctttcccagagttaaagttattcacacatcaaaaacgattcatgggcagatttacatccccgatgtcaactggttattgatgatttttagcctcactgtcaccattggtttcagagacattgtgaaaattggcaatgcaacaggtttggctataatttgtggaatgcttgtgacaactagtctgatgtcactgatcattgctctgtattgggagaagaatttgatggtatctgcgtgctttcttgtatgttttgggttccttgaggctgcatatctttcagcatgtctgctagaattccacaaaggagcttggtatctggttgtcctattggcagtgtcaatgacagtgatgctttcatggcattatggaacaatgaagaagtacgagtttgatttgcaaaacaaggtatcaaccgaatggctaatagatattagtccaggccttgggatttccagggtacccggaatcggcttcatttacaccgacatagtagcaggaatcccagctttcttttcacattttataactaatcttcctgcatttcatcaagtgttgatcttggtgtctttcaagtctatagctgtgccttatgtaccagaaagtgaaaggtatctcattggtaggattgggccaaaggattacaaaatatatcgttgcattgtcagaagtggatattgtgaccacataagggacactggtcattttgaggagcagataattcgttctattggggaattcatatccattgaacagaatgacattgagtccatggtatccccagatgaaagaatgatcattattggaaattcaaattcaagactagatggaaatgctttagttcctcttgatgaagtagactcatcatcatgcatggtgaacaatgaatctcagataagtccagtagatcatgacgcattggagagtaggaacaagagaaaaaaggttcggttcatgttgcctgagaatagtcctaaaatgcaggtatctgtgaggaaggagcttttggagctaattgatgccagggagagtggcagtgcctatttcttggggcagtcacatttagtggtgcgtgatggcactaactttctcaagagattcttaatcatggtctatcgtttcagtgaaaaaaattgtcgggaatctcctgttgctcttaagatccctcatgctgctcttgtagaagttggtgtgatatgtactatataa

SEQ ID NO: 2997 - DNA, 1980 bp, Glycine Max
atggaaattgcactttcccctcacaaatcccaaacctctcttctgggttcttcctttcccgggaatctttcctctttggggtgttgttttgcgtcaaagatgagatttttgtgcaacccattttcccggatttgttgttcctcctccatggatcaaaagctgaaacccaaaccaaagaaagttgagtacatggaaaggaatgttccagttttggaagacacccagatcaggaaaacgtccccttctggactctgtagtcagatagaaaagttggttgtgtgtaataggcaccgggaggcaatggagttgtttgaaattttggaacttgaacatgatggttatggtgtgggtgctagcacttatgatgctttggtgagtgcttgtgtcggtttgagatcgattagaggtgttaagagggtgttcaattacatgattaatagtggatttgagcctgatttgtatgtgatgaacagggttttgttcatgcatgtgaaatgtggtctcatgcttgatgcgcgcaagctgtttgatgaaatgccggagaaagacgtggcttcgtggatgactatggttggtgggcttgtggacactgggaatttctcagaagcttttaggttgtttttgtgtatgtggaaggagtttaatgatggaaggtctcgtacattcgccaccatgattcgggcatcggctggattgggtctttgcggtagcattgaagatgctcattgtgtatttgatcaaatgccggagaagacaactgtaggatggaattccattattgctagctatgcactccatggttatagtgaggaagctcttagtttatactttgaaatgcgcgatagtggcactacagtagatcattttacaatttcaatagtgatacgaatttgtgctagattggcatcattagaacatgcaaaacaagctcatgctgctctggttcgtcacggttttgccactgatatagtggcgaacacagcacttgtagacttctatagcaaatggggtagaatggaagatgcccggcatgttttcaacaggatgcgccacaagaatgttatatcttggaatgcattgattgctggatatggcaaccatggtcagggacaagaggctgtagaaatgtttgagcagatgcttcaagaaggggtgactcctacccatgtcacttttcttgctgtcttatctgcttgtagctattcaggattatcacaaagaggttgggagattttttactctatgaagagagatcacaaggttaagcccagagcaatgcattatgcgtgtatgattgaactattaggtcgtgagagcttattagatgaggcttatgcactaataagaactgctcctttcaaaccaacagcaaacatgtgggcagcattgctaacagcgtgcagaatgcacaagaatttagagctggggaagttagcagccgaaaaactttacgggatggagcctgaaaagctgtgtaattatatagtgcttctgaatctatacaacagttctggtaaattgaaggaagctgctggcattttacagaccttgaagaagaaaggtttgagaatgcttccagcatgtagctgggttgaagtcaagaaacagccatatgccttcctttgtggcgacaaatctcactcccaaacaaaagaaatatatcaaaaagtggacaacctgatggttgagatatgtaagcatggttatgctgaggagaatgaaactttgcttcctgatgtggatgaagaggaacagcgcattctaaaataccatagtgaaaagctggccatagcttttggactcatcaacactccacattggacccctctgcaaattactcagggccatcgtgtgtgtggtgattgccacagtgcaattaaacttatagccatggttacaggacgagaaattgtggtaagagatgctagtagatttcaccattttagaaacggtagttgttcttgtggtgattattggtga

SEQ ID NO: 2998 - DNA, 3504 bp, Glycine Max
atggaacaatcaagattccaaaacacggttctatacaataacatggaacctagacatgatgaataccaccaccctgggtcacagtcagtgatgcaggaccatatggatggcacacatgccggtagaagaccagctgacctcaatacatcagaagttaaacctgtacttaattactccatacagacaggtgaagaatttgctcttgaatttatgagagatagggtgaatatcaggaagcctgtattatcaaatgtcagtgattccaattataccccaggttatatggaattgaaaggcattttaggcatcagtcatgcaggatctgaaagtggatctgatatttctatgctctcaatggttgacaaatatccaaaagaatttgatagaatgaatacatcattacctggagacagaagcaactatgggtcgattcgatcaatgccaagaacttcattgaatcaggacaatagacaatttgtgcctggctatggctcttttggagtttatgatagatcaatgatgatgaagtttctttgcagctttggtggtagaatattgccacgaccatgtgatggaaagctaaggtatgttggaggccaaacacgcattcttcgaataagaaaggacatatcttggcaggagctcatgcagaaagcattacaaatatataatcaggttcatgcaatcaagtatcagcttcctggggaagatcttgatgctttggtttctgtgtcctctgatgaggatttgcagaatatgatggaggaatgtaatcatcttctagatagagaaggatcacaaaagcttaggatgtttttgttctccatgagtgatttggaggatgctcagtttggtctcagcagcattggtgatgattctgagatccagtatgttgttgctgttaatggcatggacttggaatcaagaaaaaacacaaccatgtttggtgtcagtttttctgcaaatgatataaatgaattggacaggcaaattagtattgacagggagactagtagagttggtgtagaatctattgcacaaggtgctcccctgactaacaattttaactcatcattggctactcagtcttcaccaccagtgctaccaacttcctcaaattcttatgatgcgtatccacagttttatggtgatcaaatgatacgccgtggggaacctagtgatcaatatattattaatcatggccttattccttctcataaacctgttattggagagactcctatcattatgcctcctcatatgcttgttaatcaacaagggattttgagtgaaggccttccacctcatggaatacaagtacaaaattcagaaatagcaggaacatttgcaagcaatctggttgatagttcaattcaacaaggaagtgaccctgggaaaatttttgcctcagaattaccatcaacagctcctgcacaactgcttaataatggttacatgaaaaataattttcctgaagcatcagttgttgttactgcaccagaggggcattcgttgcatccaacaaagatggacaagctcccagattatgaagagacttcttctacatctagcagtgcatttggtcctgcttatgttgattcccactacaatgcagctgacttgagttctcttcatcctcctcctcttcctaaaagagtttactattcggagagaatttcacgggaacaattagagttgttgaatcggtcctcaaaatcagatgatacaaacagttctcagtttcatgtttcagatttactttctgatgtcaacccaccagattcagttacagaatctggtgacaacagtcagatgaaatcaaagctaactgagcatgtgagtcctgagttgaagcaggtatcattggacaatggaggacgcaaagatttgttaaataaggataatgttgttgggttggaaacagaaatttatagtataaataactataacaaacccctgattgatgagacaaaaaccagcaaaccagacttgcctattttgcaccaggtctcttctgataagcaccttgatgatccagcatccattcttccagaagttgattgggcgcaaggtgacatccttattgatattaatgatcggttcccacgtgaatttttcactgatatgttctctaaagcagtacttgaagaagatccctctagtctgcatccattaacttcagatggagtgggcttaagtgtaaacatggaaaatcgtgaacctaaacgatggtcatattttcaaaaattggctcaagaagggattgataatgtgtctcttatggaccaggatcatcttgatttttcaccaggaaaagtggttggagaaaatagggctcaacatgttaaacctttaacaactgatgaagtttctctgaaccatgcagagtcccaccttgattttgttgaagaaaatataagagacttgcatggaaggattggagcagaaaccactgttctaaagtcaaattatgatcattcccaagtgaacgacaccgaaagtatgcaatttgatgttatgatggaaaacataagagcacaagagtcagaatatgaggttgggaagtttgaaaaaaggaatagcaatctacctcctcctgatccttctttagtaggagagtttgatccaagtaccttccaggtcataatgaatgatgatcttgaagagctgaaggaactgggttctggtacctttgggactgtgtatcatgggaaatggcgaggaacagatgttgccattaaaagaataaagaaaatctgcttcactggtcgatcatctgagcaagagagactgactgtagaattctggcgggaggcagaaattctttccaagcttcatcatccaaatgtggtggcattttatggtgtagtgcaggatggaccaggaggaacaatggctactgttgcagagtacatggtggatggttctcttaggcatgtattacttcgcaaggataggtatcttgatcgtcgcaagagactgataattgcaatggatgcagcttttggaatggaatatttgcactcaaaaaatattgtacactttgacttaaaatgtgacaatttgttggtgaacttgaaagatcctatgcggcctatatgcaaggttggggattttggcttgtcaaaaattaaacgaaataccttggtttctggtggtgtgcgagggacacttccttggatggcaccagagctgctgaatggtagcagcaacaaggtctcagaaaaggttgatgtgttctcctttggcatagtattatgggagattctaactggtgaggagccatatgccaatatgcactatggtgcaatcataggtgggattgtgaataacacattaaggccaacaatcccagatcattgtgattctgaatggagaacactgatggagcagtgttgggcacctaatcctgcagctaggccatccttcacagaaatagccagtcgattgcgcataatgactgcagcagctagccaaaccaaaacacagaaggcatctaaatga

SEQ ID NO: 2999 - DNA, 885 bp, Glycine Max
atggaacagtacgagaaggttgagaagataggcgagggaacatacggcgtcgtttacaagggtcgcgaccgctccaccaacgagaccatcgccttgaagaagattcgcttggagcaggaggatgagggggttcccagcaccgccattcgcgagatttctctcttgaaagaaatgcagcacaggaacattgttaggttgcaggatgtagtacatgatgagaagagtttgtatctggtttttgagtaccttgacttagatctaaagaagcacatggattcatctccagaatttgcaaaagatccacgacaactaaaaatgttcctgtaccaaattctctgtggcatcgcttactgtcattcacgtagagttcttcatcgagacttaaaaccacagaatttgttgatagatcgcagcaataatgcactaaaacttgcagattttggattggctagggcttttggaattcctgttaggacatttacacatgaggtggtaacactgtggtacagagctccagaaattttgcttggatcccatcattattctaccccagttgatatttggtcagtgggatgcatatttgcagagatggtaaatcaacgacctcttttccctggggactctgagattgatgaattgtttaaaatattcagaatcatgggtacaccaaatgaagacacatggcctggagtgacatcattgcctgattttaaatcagccttccccaaatggcagcctaaggacctgaaaattgtggttccaaatctcaagccagctggtcttgatcttctttctagcatgctttacttggatcccagcaaaagaattactgctaggagcgctcttgagcatgaatacttcaaagacattaaatttgtaccctga

SEQ ID NO: 3000 - DNA, 996 bp, Glycine Max
atggaaccaccaagccagattgtctcattgcggactaccacgactgatcccgatcatgtgaaagtcattcagtgggacgacttccagcacgatcttgcaaggttggcgagtctctcttctgcactccacgaagccaacgagaagaagcggaatcttcagcacaagctcgagtccctaatccaggtcaatgctgaatcattgggtcggttgaatgaacttgaggagatgcgtcagaaattggaatcaaagaaaatgttgatggagaatatgtctatatgttctaggctggcaaaggaggaagctagcaagcaggaggagcagcttagtggtgcagtgcaatctcttttggtgtcagggggtgctctttctgtaaccagcagaaatctccaggaatcaagtagattactgtctgaagaaaatggttatgttcatctgagaaaattgcaaaagatgctcaggaagaggcaacaatatatgacatctcaaatttcaatgctctatcctgttaagatcttggttgggccagcacaagagcaagagcttgaagcatatcctttaggtagcctggcagggacttctgctggacttaaaccaattaatcaaggatccttaacaattcatggtctgcatttgaatgtgctatcttttaggaagatgagctttttcactgataaaaaggaaattcagaattctgctacagccctaggatatgttgcacatgctgtttcacttatagcctcatacttgcaagttcctttgcgatatcctttacggttgggtgcttctcattcatatattattgacaatgcaccttcaacagagctaacatcgtctgaagcttcatcaaatgcaaacataaatgccaaacatgtgaaatttcccctttttttagaaggtcaagacacaacaagagcagcttatgctgttttcttactaaataagctgagattacttactctagaggagccaaatgcctttgttcgtttcatgacatga

SEQ ID NO: 3001 - DNA, 1065 bp, Glycine Max
atggaaccaccaagccagattgtctcattgcggactaccacgactgatcccgatcatgtgaaagtcattcagtgggacgacttccagcacgatcttgcaaggttggcgagtctctcttctgcactccacgaagccaacgagaagaagcggaatcttcagcacaagctcgagtccctaatccaggtcaatgctgaatcattgggtcggttgaatgaacttgaggagatgcgtcagaaattggaatcaaagaaaatgttgatggagaatatgtctatatgttctaggctggcaaaggaggaagctagcaagcaggaggagcagcttagtggtgcagtgcaatctcttttggtgtcagggggtgctctttctgtaaccagcagaaatctccaggaatcaagtagattactgtctgaagaaaatggttatgttcatctgagaaaattgcaaaagatgctcaggaagaggcaacaatatatgacatctcaaatttcaatgctctatcctgttaagatcttggttgggccagcacaagagcaagagcttgaagcatatcctttaggtagcctggcagggacttctgctggacttaaaccaattaatcaaggatccttaacaattcatggtctgcatttgaatgtgctatcttttaggaagatgagctttttcactgataaaaaggaaattcagaattctgctacagccctaggatatgttgcacatgctgtttcacttatagcctcatacttgcaagttcctttgcgatatcctttacggttgggtgcttctcattcatatattattgacaatgcaccttcaacagagctaacatcgtctgaagcttcatcaaatgcaaacataaatgccaaacatgtgaaatttcccctttttttagaaggtcaagacacaacaagagcagcttatgctgttttcttactaaataaggatttagaacagcttttgaatttcattgatgccaagactttggggccacgccatgtattggctaatttgagggagcttttaaggactatccagtcttcagcttttatagacaacttgatctaa

SEQ ID NO: 3002 - DNA, 874 bp, Glycine Max
atggaacccgcgaaaattgattggaagaggctagagtggagcttcgtggaagacaagctctacgagcacatcaacgcgcccaagtgggttgacttcttgtcccttgaccactccctcaatgatcatgctgacgaagcttggttctgcaagcctgattgcaaacatcccaagacagcagaggattttctgagatcaaaaactcctccttccaagaagggttttagcccgggttatgtttcagagaatcttccaagtggtgacaaaattagaagagatgcgaaaatcaagagaagggtgcctgcactattcaaccaagaaagtgaaaaccaaaacccgaatttgtttactcctcctcctactactaaagttaaccccttgaaggaagcaatcaagtctactgaagagaagaagaaagtggttgataatgatgacacatttgtggatcacaaggcgccttcattgagatcaactctatccaccaagaatttgtttgccgggaggcctattctgaatcaaatcacggaattctgcaatgaattgaagaaattggcaataagagctaaggagagagaaaatgctgaaaatttgatcccaaaagagagtgaagaggtggtggagaagacctcttgttctattcaagctttagctgagtcagatacaaaagagaaagaaaggaaaccactgcttgaagtgagtaaggctgaaagaattgaagggatgtgtgttaaagggaagcaacagagaaaaaaaagacctgatgaggcagagaacatgccagtaactcttgacctggagaatctaaagcacaagagggaggggagcttacaacaaattagaacaaatcctccctctcctcagtgcttctctgttgcac

SEQ ID NO: 3003 - DNA, 1038 bp, Glycine Max; identical to SEQ ID NO: 294

SEQ ID NO: 3004 - DNA, 543 bp, Glycine Max
atggaactaattcagaaggagaaagctcgcaagacaacattcaacaagagaaagaaaggattattgaagaaagcttatgaattttccattctttgtgcggttgatgttggtataattatctatgcccccaagtttcttgatgaacctgaaacatggccccaagaccaagactcaagagagttaaaacgtgtcattcaaaaatatcagaacaccactagtgacagatgtcctaaggtgtatagtgtgcaagagtattttaacgacaaaatgaaaaagattgaaggtgagatttccaaagtgcacaaagagaagatcaaactcatgtatccaacttggaatgactcttacaatactcttggagaggaacaattgaggatgtttgttagtattttggatgctaagtttgatgcttgtagtcaaaggatgaatatgttaaagaagggaaaagacaaagttgagacacttactccctacatgacctcaaatgtaggtatgcaaaacatgtctcaaacacaatttttcccacctagtgataacaaacaa

SEQ ID NO: 3005 - DNA, 951 bp, Glycine Max
atggaactacgtgagcttggaagaaccggactgaaactcagcactgtaggattcggagcttctccactgggcaatgtcttcggcgatgtttccgaggaacaagccaacgcttccgttcgcctcgctttccaatccggcatcaatttcttcgacacttctccgtactacggagggacactgtcggaaaaagttctgggaaaggcactgaaggctctgggagctccgaggaactcgtacgttgtggcaacgaagtgcggacggtacaaggagggtttcgatttcagcgcggagagagtgacgagaagcattgaagagagcttggaaaggttgcagcttgactacgtcgacattctccaatgccacgacatcgagttcggctccttagaccaggttgtgaatgagacgattccagcgcttgtgaagctgaaggaagcagggaaggcgcggttcattggaataacagggcttcctctggggattttcagttacgtgcttgatagggttccgcctgggacgctggatgttgtgctttcatattgccattactgtgtgaatgacactagcttgggggatttggtgccctatttgaagaccaaaggggttggcattatcaatgcttctcccttgtctatgggccttctcaccgagtctggcccgcctgaatggcatcccgcatcactggaactcaagtctgcatgtcaagctgctgctacccattgtaaagaaaaaggaaaaaacatttcaaagttagcattgcagtacagcttgttaaataaggaaatcacatcagtgcttgtaggcatgaagtctgttgaacaggtggaggaaaatgttgctgccgcaagagaacttgcaacttctggaattgatgaagagactctgtctgaagtcgaagctattctgaagcctgttaaaaaccagtcgtggccaagtggaatccagcagagctga

SEQ ID NO: 3006 - DNA, 1362 bp, Glycine Max
atggaagaagaagaagaagggcttgccatgctcatcactcaccttcaccatttctctcactctctttctcctctcttttttacccttcaccctcctctactctctcatcaactccccagattgtccttctttgacattgatgattactccttagatgacttctgtggccttgtaatggcagctggaaagtctggaagttccaggatgttggagcctctaaagcatccatctaagaagtctcgaagagataggagccttggaaaatcatctggaaggtcctccagggatgaagctatggaacaacaaatttggaaaaaattgcctgaggatctatttgagcctgtgattgcacgacttcccattgccacatttttctgcttccgctctgtatgccagcgatggaattccttgctgacttctcaaagtttttctcagcattgtgctcaagtcccacaagcaaacccatggttttacaccgtaactcatgaacatgcaaattccggagccatgtatgacccttctatgaagaagtggtatcatcccactatatcaacactgcccgcagagttgatagttttgccagtggcttctgcagggggtctagtttgctttcttgacatttatcgtcaaaatttctatgtttgtaacccattgactcaatccttaaaggagttaccagctcgttcagttagggttgggtctcgtgcgtctgtagggatgacagtaaatggaaactcaactagtgctggctacaagatcctattagttggttgtgatggagaatatgaaatttatgactcagtgacaaagtcttggagccatccagaaaacatgcctgcagatattaagctcccgctgtcactcaattttaggtcacaggccgtttctattgacagcaccctgtacttcatgcattcagatcccgaagggattgttttgtatgatatggcaactggggtttggacgcagtacataatcccagcaccattgcatctgactgaccacatgctggctgagtgcgatggccggatattgcttgtggggttgctcacgaagaatgcagccacatgtatatgcatatgggagctgcagaagatgactttcttgtggaaggaggttgacagaatgccaaacgtctggtgcttggacttttatgggaagcacgttagaatgacttgcttgggaaacaaaggcttgctgatgttatccttgagatcaagacaaatgaatcgattggttacttacaacatagcaagtagggaatgggtgaaggttcctgcgtgtctggtgccacatggaagaaaacgacaatgggtagcacatggtactgcattttatccatgcctcactgcaatggcttga

SEQ ID NO: 3007 - DNA, 1362 bp, Glycine Max; identical to SEQ ID NO: 3006

SEQ ID NO: 3008 - DNA, 498 bp, Glycine Max
atggaagacttactcggccttttaaggattcacatcaagcgcggtgtcaacctcgccgttcgtgatgtcaatactagcgatccatacgtcgtcgttaagatgggcaagcagaagctgaagactcgtgtgattaaaaaggatgttaatcctgagtggaaggaagatcttacgctttctgttacagatccaattcatccatttatactgacagtgtatgactatgacactttcagcaaggatgacaaaatgggagatgcagaatgtgacatctcagcatacatagaagccttaaagatgaacttagaagacctccccagtggtactataatcacaagaatacaaccaagcaggcaaaactgtctggcggaggaaagttgcatcacttatagcaatggcaaagttatccaagatcttgtccttagattgcgacacgtggaaagcggtgaagtggaaatccaattgcaatggattaatcttcctggctccaagggtttatga

SEQ ID NO: 3009 - DNA, 1131 bp, Glycine Max; identical to SEQ ID NO: 295

SEQ ID NO: 3010 - DNA, 663 bp, Glycine Max; identical to SEQ ID NO: 296

SEQ ID NO: 3011 - DNA, 1293 bp, Glycine Max; identical to SEQ ID NO: 297

SEQ ID NO: 3012 - DNA, 2769 bp, Glycine Max
atggaagcaagagaacatgttgcaccaaaaaaaccaatccttacacctaaagctataatacaccaaaattttggcagtagggcttgctatgtggtagaggaagtgaaggaggctcctcaaactgaatgtccaggattgaatattccacaaatgggtccctgcctttaccgttgcacattgcagcttccagaactttctgttatttcaggaacctttaggaaaaagaaggatgcagagcaatctgcagcagagattgctatagacaagcttggcatttgtacagagaccattgatcctactccacaagaagcacaagaaagtttagtatctcgaatcaccttcatattttctgaaaagtttgttgtatgtgatcatccactcagtggtcacattcgagcaactttgtggaggaaaggtgatctttgtggttccattcctctttctgtcattgctttctatgatgcaaagcttttcaacttgtgcaaatgtattaatcctgaggtggagtcaaacccatttttagttatttcatacataatgagggccactgcaaacttacaccagtttcttgctacttctgaacggcatctctggattagaaggctgagtccatatccccaagatattatagagtcattgatgaaagaacatggttcacaaaaatgcatacaggttactgctgtacacattcctagttcagttgaacaatcgattgaagcagtgactcttcatatttcttcaagagaatactaccttgatatcattgcaaatgaacttggttttgaagatgcttccaatgttctgatttcaaggaatttgggtaaagcttcttctgagacaagactgttctttactgctccaaaatcatatctaccggatctatcttctaaatttccaaatggaaaagaaactctttatttaaagggatctctgaatgtaagggcaagttactttgccgggcaagatataaccggtgatgcaatattagcatccattggatatacacggaaatctagagatcttttctatgaggattttacaaagataaaagaaccgatagtaggggaagagaaacaaggaacagaagaagtaatgaggctgatgcttctagggaagaccccaggcgggatttataaattgtccagagaggcaatgcttgcatccgagttgccatcaagattcacctcaagagcaaactggagaggttctcttcccagggatatactttgtatgttttgccgccagcaccgtctgtctgaacctctcttttcatttcatcctatcaaaacaacatctggattatcaggatcatgtttgaaggttgcagaatctggtgagaatgtgattgagtgtgtcaatgggttctctgtaacaagtccaaagcattcagattctgagttgtttaaatgtgaaataaaattactttctaggtgtggagatttgatacttttgtgttccccaaaagattgttataagaagcagaatgatgctattcagaatgcttcattgaaagttctatcatggctgaacatgtgttttaagagtatgattctcccttttgagcagctttatgagactgtagacaactttaatattcagatctattccaaaaacattatcagagatcttttagcaggccaatcaactcacaatggtcagcttaatggaattcattgcaataatggatctttaccttgtataaggtattcagtttctttggctgtagagggtgagaatctgaaagaagttattgaagtttgtgatgagtttgagtttgaagtgggagttggtgctgtggtttcctatgttgaggaggttgtgatgcagatgtctgttgtgagttacttctctcaactcccccccccccccccttcagtgtgggttaaattgctgactgggtcaatgcctttatatttttatttttcagaaaaatgttgtatggaatatgaaataagtttgatcagagttgcagaacctcctgaggaaagaatggagcaggctcttttcagccctccactttcaaagcaacgagtggaatttgcagtgcaacaaattctagaatcccatgcttctactttgattgattttggatgtggttctggaagccttttggaagcattgttaaattatccaacatctttaaagaaaatggctggtgtagatatttcacagaagggtcttagccgtgctgcaaaggttcttaactcaaaattagtcacaaattcagatgctggtgggcacttgacaagcatcaaatcagtaattctttatgaaggttcaattacaaattttggctctcagttgcatggatttgatatcggtacttgtttagaggtgattgaacatatggatgaagatcaagcttgtctatttggggatgtggcattaagtttttttcgtccaaggattctcattgtttcaacgccaaattttgaatacaatgtagtactccagaagtcgagtcctccaacccaagaacaagaggaatcagacgagaaaaccctcttacaatcatgtaaatttcgtaatcatgatcacaaatttgagtggaccagagagcagttcacacaatgggcatctgacttagctgctcggcacaattacaatgtggagtttggtggggtcggtggttctgctgatgttgaacccggctatgcttcacagattgctgtgtttaaaagggattggaaacttgaagatgatgtactaaagcatgctgatgaacaccattatagtataatatgggaatggaatagtaaaaaagaataa

SEQ ID NO: 3013 - DNA, 1071 bp, Glycine Max
atggaagcacgtgcaggagccaatcaacgtattgcaagaatctctgctcatcttcagccttcaaatttccaggaagggagtgatgttcttcttaagagaggtgagtgcagagcaaaaggtggggcacctggattcaaagttgcaattttgggggctgctggaggaattggtcaatccctttctttgctgatgaagatgaacccattggtttcagttcttcatctttatgatgttgtcaacacccctggtgtcacagctgatgttagccacatggacactggtgctgtggttcgtggctttctggggcagcaacaacttgagagtgcactcactggcatggacttggtaatcatacctgctggggtgccaaggaaacctgggatgacaagagatgatttatttaaaataaatgctggaattgtgaggaccctttctgaaggaattgccaagtgctgccccaatgcaattgtcaacttgattagtaatccagtgaattccacagttgctattgctgcggaggttttcaagaaagccggtacatatgatccaaagcgactactgggtgttacaacccttgatgttgtgagggcaaatacttttgtggcagagatacttggagttgatccaagagaggttgatgttccagtggttggaggtcatgctggagtcacaattttgcctcttttgtcacaggttaagcctcccagtagcttcactgcagaagaaactgaatacctgacaaatcgcatccaaaatggtggaactgaagttgttgaggcaaaagctggggctggttctgcaacactgtcaatggcatatgcagctgccaagtttgctggtgcatgcctccgtggcttaaaaggagaagctggggtagtggagtgtgcttttgttgattctcaggttacagaacttcccttctttgcaaccaaagtgcgtctaggtcgtgctggagcagaagaagtttatcaactgggtcccctgaatgagtatgaaaggattggattggaaaaagcaaagagagagttagcaggaagcatccagaagggtgtagagttcatcagaaaataa

SEQ ID NO: 3014 - DNA, 1803 bp, Glycine Max
atggaagcgttttacacaactctctcctcccctgcgtccacgtctgttctcaattttcagggctctgaattgcctagaagaaatctttgtaagaaatcttcacacactatttttgcatcacctacgctgcctaaaccgtttcttcagatttgtggtagacctcagacattgatttatacgtcaacccgactctcttctggagcacatagagcaacaatatctgctgaagctggaagacaaaattgggattttggaagatttgttaaaacactgttcttcttcaatgggttcccatctcctgctaagttctttgattttctagctgagaaaatatctgatccttcccctagtgaagtcattaacacaatgggaacttctgatattgtcctggtagctggagcaactggtggtgttggtcgaagggtggttgacatattacgcaagaaaggaattccagtccgagtattggttagaaatgaagagaaagcaaggaagatgttaggctcagatgttgatttggtcattggagacattacaaaagatagcactttgatccctgaatactttaaaggcgtgaagaaagtgattaatgctgcttctgtcattgttggtcctaaggaaggagacactccagacagatcaaaatacagccaaggaattaagttctttgagccagagataaaaggtgactcaccagaaaaggtagagtacataggaatgagaaatttgatcaaggctgtgaaggacaatcttggacttcgaagaggaaagctattatttggatttgaaggcattaattacaggcagcttccttggggtgctttagatgacgtggtaatgggtggagttagtgaaagcacatttcaaattgacccaagtgggggtgaaaatggtggaccaactggggtttttaaaggtgttgtttcaacagcaaacaatggtggctttacaagtatcagaactaagaatttctcagagcctgaaaatctttctgcatatgatggtttggagttccgcctaaaaggtgatgggcgtagatataaaatcattgttcgcacaagcagtgattgggacactcttggttacactgcaggctttgacactgagaaaggaaaatggcaatcaattcaagtgccattttcttccctgagtcctgtatttcgagcaagaacagtgtccaatgctccaccatttgatccaagcattgttgtatcattacagctcatgttcagcaagtttgagtctgatggtaaattaaatgaaacttttgtggaaggtccatttgagcttccggtgtctagcatacgggcatatataaaggatccaataacacccaggtttgtgcatgtgagctcagcaggagttacaagacccgaaaggcctggaatcgatctaagtaaacagcctcccgccgttcgattaaacaaggaactggattatatcctcacatttaaactaaagggcgaggatttacttagagaaagtggcattccctatgcaatcgtgaggccttgtgcattaactgaggagcctgctggtgccaatcttatttttgatcaaggagataatattacgggtaaaatatcaagggaagagattgctcttatgtgtgtagctgcgcttgatagcccttacgcatgtgacaaaacatttgaggtcaaaagtgtcattccatttagcgagccatttactgtggatccaacaaaccctcctccagaaaaggactatgacgtatattttaaaaatttaaaagaaggcattactgggaaggaagctctccaacaaaatcctgtttctgtttag

SEQ ID NO: 3015 - DNA, 1302 bp, Glycine Max
atggaagctacatctaaatgcagaggttacaaaaagggtgttttatttcccacaagcacttctatgcatggttgctatgcctccaaaaatatctctatttctcagccaaatggagaagcaaaagctatctgcatgggttgcaaagaagagtgtcactgtttaatgccctcaagaacaaccttacaccgttgttctgtgtgcctaaaggttagcaattcaactttgggaccacatggtttaaagaaagaatgtgcaatatgccgtccagtgaagaaaattggagccaaattgttgaaacttggagatctaggaagttcaaagaaaaatggaaatttgctgagtgggtcattattacctccttcaatgccctcttcttccttagccttgcctagcactagcagatataataaacgtgcggttctctgtggagtttcttacagaaaaaggaaattcagactcaaaggaaccattaatgacattagtaacatgaaggaactgcttatcaagaattttaagtttccaaaggagtgcatacgtgtcctcacagaacaagagcagaatgccaatttaataccaacgaaacacaacatattggagtccttaaactggcttgtgaaggactgtcaggcaggagattcattgctcttttacttctcgggacacggtttgcaacaaccagatttcaaagaagatgaaatcgatgggtttgatgagactctttgtcctgttgattttttgagggaaggaatgatcattgacaatgaaataaattctaccatagtttggccactaaaggaaggtgtcacacttcatgctattgttgatgcttgtcatagtggaacaattcttgatcttttgtttgtttataaacatgaaagtggcatttgggaggataacaagcccccttcaaaagaacccatcagaaaacatacaagtggaggaatggcaatttgtcttagtgcttgtgaagatagtcagacagctgctgatagctcagtttttggtggaaagggaatgaatggtgttctgacttatcttttcacaaaaacaatcagagaataccctggaataacttatgggggtctcctagaaaagatgcatgacgaaattaaaaagattaaccgaagcagatgcaataaccgcatattgcaacatatcttcaatcgatcctcttttatcaacatatacctacacgaggctcatcaagcatatctcatatataatcttttcccccatcaattgatcctcttttatcatcatcagagaaatttgatgtttctacgacaatgttcaaatttttag

SEQ ID NO: 3016 - DNA, 1596 bp, Glycine Max
atggaagctgtgtatgctttttctgttggcacacttcacatcccgacagcacatgaaacaccaaactcatttaggaaatctatattcttgagcaaccaagtggcttcaccagtttcattggttctcaggggcgcttcaaaatccaagcttttcactgccttgtcaccccctccattgacagaatccagcaacaaccaacctgaggaggctgagccagaatttgaaagtcatgcagagaaatttgactggtactctcactggtaccctttgatgccaatttgtgaccttgacaagaggaagcctcatgggaagagggtgttgggaattgatgtggttgtgtggtgggataggaatgagggtgtttggcaggttcatgatgatgcttgtcctcatagattagcacccttgtctgatggaaggattgatcaatggggcaggttgcagtgtgtgtaccatggttggtgtttcaatggcaaaggagaatgcaagctcattccccaggcaccccctgatggccctccggtacatacgtccaaaaaagcatgtgtagctgcttacccaagtactgtacagaatgatatcttgtggttctggcccaatactgatcctcaatacaaagatattattacaagaaaaagacccccatacataccagaattagatgatccatcgtatactaaattaatgggaaacagagacatttcttatgggtatgaagtactgatagaaaatcttatggaccctgcacatgttccatatgcacactatggactaatgcgtactccgaaaccaaaagtgaaagttgatagagaagggggcaggccacttgaattgtctattgaaacgttagatatcaatggttttactgcaaatcagggttggagtaaaagtaaatttatgccaccatgcattttttatgtatatactgattcagatcaacctgcctcatctgctgaaactcagaaatcatcagctcagaagaagtttgctttaatctttgtttgtgttccggttagtcctggtaaaagcagattgatatggtgcttcccaagaaactttggagtgtggattgacaaaattgtgccacgatggatatttcatgttggacaaaaccggattctagattcagatttatatcttctccatgttgaggaacaaaaaatagttgatattggtccaaagaattggcacaaagcctgttttgtgccaacaaagtcagatgcccttgttattggttatagaaattggttaaagaagtatgcaggtggtcaggttgattggagaggaaaatatagtggggctctccctccaacacctccaagagaacagcttatggacaggtactggtcccatgtggtgaattgcaagagttgcaattctgcttataagagcctcaatgtgattgaagtaatgttgcagatcatatctgttgcttcaattgggattgttgccatcatgaagcatggtacaatgtcagtggcaaaaagaaattcaatggttgcgttagcagtgctatcattagcactgtctcggtggttggctcacttcatatacaaaaacttccgttatcatgactacgagcatgccttccgctaa

SEQ ID NO: 3017 - DNA, 192 bp, Glycine Max; identical to SEQ ID NO: 298

SEQ ID NO: 3018 - DNA, 1275 bp, Glycine Max
atggaaggaagtgatcattcattagtaccacaatggctgaaaggcagtggaaatgacagtagggtggctggtataaacaaccaattcacatcatcgtcatactctgatcatattacttattctggtcgccaatggagttctagtagcaaaggtcctggccactcaaggtcatatagtagttctgagagaagctggcaggatacatattgggagaaagatattggcagtgatggcctgaactcagcatcacatgatattcctatgacagttagcaaggctatgatgatgcatcggtataatgttcctacaagcacatcttctattactcttggcacaatgggcctcagtatggctgagacattggctcagggtccacctcgctctcactcaccacaattatctgctagtactcaaaagcttgaagcgttggcccttaagcaatccaggttattaatccctgtgacaccatccacaccaagatccctggtttctagctcctcagagaaatcaaaggtcaagacagggcagcagcagtattccttctcccattcacgtcgacccaatcattctttacatggtgctcatccgaacttagatatacagaaaattagttctggtaattcccttagtgtcaatacttcccgagagtggaatggtgtctcttcagctgcaaaggacaacttaagtcccaatagtagagttgtgcttagtccagttggtgccactagatccacttctctatctgctccttctaggaacttaggtaacaattcaaccccttctgcatggataacattggagaagaggcctacttttcctatccagagcaggaatgatttcttcaagaatctttcaaggaagagttccttggaaaaaccttgttctgatgttttgtctattgacatgtcttgtgccttggagaattctgaagccagcatgaggaatgtctctagttgtcccattctggagtctagagatgcttctttagtggatacctctggtttgaacatgttgactgactacggatccacaattactgagaacggcaatgctgccaatgaacctttgaaactttcaagcagcagtgagaagcaagatagcagaaacccatttccttatccagatgaggaagagattgcatttttacgttcgcttgggtgggaggaaagtgctggagaatatgatgaaggcctcactgaagaggagatacaagacttctatgagaaggttattattcttttggaactttcttttgctatgcttaatttggaatga

SEQ ID NO: 3019 - DNA, 1383 bp, Glycine Max
atggaaggaagtgatcattcattagtaccacaatggctgaaaggcagtggaaatgacagtagggtggctggtataaacaaccaattcacatcatcgtcatactctgcatcttcttttgtttttaaaaaaagtaggaaaatgatgttatttcgaagtgtggcctattttataccaaaaagtgaaatcttgtactttgattcatcaatgtatgatatttttagtcaccaaatgttgtgtctggcaaatattgtcatccaatatatggcatcatgttctagtagcaaaggtcctggccactcaaggtcatatagtagttctgagagaagctggcaggatacatattgggagaaagatattggcagtgatggcctgaactcagcatcacatgatattcctatgacagttagcaaggctatgatgatgcatcggtataatgttcctacaagcacatcttctattactcttggcacaatgggcctcagtatggctgagacattggctcagggtccacctcgctctcactcaccacaattatctgctagtactcaaaagcttgaagcgttggcccttaagcaatccaggttattaatccctgtgacaccatccacaccaagatccctggtttctagctcctcagagaaatcaaaggtcaagacagggcagcagcagtattccttctcccattcacgtcgacccaatcattctttacatggtgctcatccgaacttagatatacagaaaattagttctggtaattcccttagtgtcaatacttcccgagagtggaatggtgtctcttcagctgcaaaggacaacttaagtcccaatagtagagttgtgcttagtccagttggtgccactagatccacttctctatctgctccttctaggaacttaggtaacaattcaaccccttctgcatggataacattggagaagaggcctacttttcctatccagagcaggaatgatttcttcaagaatctttcaaggaagagttccttggaaaaaccttgttctgatgttttgtctattgacatgtcttgtgccttggagaattctgaagccagcatgaggaatgtctctagttgtcccattctggagtctagagatgcttctttagtggatacctctggtttgaacatgttgactgactacggatccacaattactgagaacggcaatgctgccaatgaacctttgaaactttcaagcagcagtgagaagcaagatagcagaaacccatttccttatccagatgaggaagagattgcatttttacgttcgcttgggtgggaggaaagtgctggagaatatgatgaaggcctcactgaagaggagatacaagacttctatgagaagtacatgaaattgaaactgtga

SEQ ID NO: 3020 - DNA, 1743 bp, Glycine Max
atggaaggaggaggagtagaagttgatgtctctgctttcagagaatgcttgtctctgtcatggaaaaatccttacgttcttcgccttgctttttctgctggaattggtggccttctctttggctatgacactggagtgatatctggggctcttttatatatcagagatgatttcaaagaagtggatagcaagacttggcttcaggaagccatagtgagcatggctcttgctggagcaatcataggagctgcagttggtggatggatcaacgatcgatttggaaggagaaaagctatccttcttgcagacacactcttctttattggttctgctgtcatggctgccgctaccaatccatctattctcattgttggtcgagttttcgttggccttggtgttggaatggcttcaatggcatcccccttatacatctctgaagcttctccaaccagagttcgaggagctttagttagcctcaatggctttctcattactggagggcaattcctctccaacctcatcaacttggccttcacaaaagcaccaggaacatggagatggatgctaggagtagcagcagtaccagccctgatacaaatcgtattaatgatgatgctgccagaatcaccgcgttggctgttccgaaagggaagagaagaagagggtaaagcaattttaaggaagatttatccaccccaagaagttgaagcagaaattaatactttgaaggaatcagttgaaatagaaatcaaggaagcagaggcctcagataaggtcagcatagtcaaaatgctgaaaactaaaactgtgagaagaggtttgtatgcaggaatgggccttcaaattttccagcagtttgtggggatcaacactgtgatgtactacagccccaccatagttcagttagctggttttgcatcaaatagaacagcacttcttctgtcactaatcacatctggtcttaatgcatttggttctattttgagtatatacttcatagacagaacaggaaggaaaaagcttgtgttgttcagtttgtgtggtgttgtgttttcccttgttgttctaacagttgtgttccatcagagtacaacacactccccaatggttagtgcacttgaaacctctcacttcaataacacttgcccggattaccattcagctgtgaacccaggtggatgggattgcatgaagtgcctaaaggcttctccaggttgtggcttttgtgcttctggagccaataagctcttacctggggcatgtttgatctccggtgacaccacaaaagatcagtgccataaagaagatagactatggtacaccaggggatgtcctagtaaatttggatggcttgcaatagtaggccttgcactctacatcatattcttctcacctgggatgggaactgtgccatgggttgtcaattctgaaatttatcccttaaggtatcgaggaatatgtggaggaatggcatctacatccaattgggtctcaaatcttattgttgctcagtccttcctatccttgacacaagctattgggacctcatggacatttatgatatttatattcatcaccatagctgctattatctttgttattattttcgtgccagaaaccaaaggacttccaatggaagaagtggagaagatgttggaaggaagagatctcaatttcaagttttggcagagaagttctcgccatgcagaagaagtagccacacagaagactcaatcaacttaa

SEQ ID NO: 3021 - DNA, 1713 bp, Glycine Max
atggaaggaggagtacctgacgccgatatctctgccttcagagaatgcctctccctctcatggaagaatccctatgtccttcgcctcgctttctcagctggaatcggtggccttctttttggctatgacaccggagtgatatctggagctcttttgtatataagggatgaattcccagctgtagataggaagacttggcttcaggaatctatagtgagtacagcaattgctggagcaataataggtgctgcagtgggtggatggatgaacgaccgatttggaagaagaaaatcaatccttgtagctgatgtcctctttatagttgggtcagcagtaatggctgcagcacctgtccctgctgttctcatcataggtcgagtttttgttggccttggtgttggaatggcttcaatggcatctcctctctacatttctgaggcttcccccaccaaagttcggggagcccttgtagctctcaacagtttcctcatcactggtggacaatttctctcctacctcatcaacttggctttcacaaaggcgccgggtacatggaggtggatgcttggagtggctgctgcacctgctataatacaagtggtgttaatgttcacgctcccagaatcaccacgttggctgttccgacggggaaaggaggaggaagcaaaagcaatattaaggaaaatttatcaagccaatgaagttgaggaagaaatccaagctttgcatgattcagttgctatggaactgaagcaagcagaatcctcagataacatgaacataatcaaactgtttaaaacgaaggctgtgaggagaggtttggtggcaggaatggggcttcaaatcttccagcaattcacgggcatcaacactgtcatgtactacagtcccacaattgttcagttagctggttatgcatccaaccagacggcattgctcctctccctcatcacttctgggcttaacgctttcggttcggtcgttagcatctacttcattgacaagactgggagaaagaaacttgctttgcttagtttgtgtggctgtgttgtagccttgacccttttaactttcactttccgccacaccgcaactcattctccaatgattagtgcgcttgagaccgttcatttcaacaacacctgccccggtttcggccacgctgtcaatgctaatcaatgggattgcatgatgtgtctcaaggcagaatgtggctattgtgcatccggtgtctctagcaagagcttaccaggggcatgtttgatttctaatgatgcaacaaagggtatgtgtcaaaaagaacatagagcatggtacacacagggatgtcctagcaaaattgggtggcttgcaatagtgggacttgcactgtacatcatattcttctcaccagggatgggaactgttccatgggttgtcaattctgaaatctatcctctgaggtaccgtggggtatgtggaggaattgcttctacaacttgttgggtttcaaacctcattgtttcccagtccttcttgactttgaccgtggctattgggacagcatggacattcatgttgtttggatttgttgctctcattggcatcttcttcgttctcattttcgtgccagaaaccaagggagttccaatggaagaagttgagcaaatgctggaggaaagagctgtgcacttgaagttttgggagaaggcgagtcctccccagaagggttga

SEQ ID NO: 3022 - DNA, 459 bp, Glycine Max
atggaaggaggatcgggtggtggcgagagagagaagtggaacagtgtaagtgtatacagagagtgcttgagaaaccatgcagccagcctcggaagctacgccacggacgggtgcggcgagttcacggtggacggcgcggggggactacaatgcgcggcgtgcggctgccaccgcaacttccaccggaaagtgaagtacccggtggcggagcatgaggagtatggaggcaagaagcggttcaggtccaagttcacggcagatcagaaggagaagatgctggggtttgcggagaagcttggttggaagcttcagaggaaggatctgaatgatgagatagagaggttttgccggagcgttggggttagtaggcaagtcttcaaagtttggatgcataaccataagaactcttcctcctcctcctcctctacccccgccaatgtctcctccctcacccagtaa

SEQ ID NO: 3023 - DNA, 498 bp, Glycine Max
atggaagggggaaacaccaagagaaaacaaaagcgagagatcaagaaaattgaggataaaaaagatcttcaaaaaactctagcaaagagaaaatgtggcatttacaagaaagctagtgagttaacaactctctgtggggcaaaagttgatatgcttatgtttacttcatctggaaaatggttgagttatggggaaccttctcaccaggcaaatatcaggtctagcgatgaagaaaatgaccctacaaaagatgatattaatgagcctgtggaggatcacgccaaatcaaagattgatgaactctgtgaaaaaaataaggcacttatacatcaattgcactatgaggaagaacgagagaataaacttgttgaaattatgaagacaagaaatacacatggttggtgggaggccaaaattcaagatcttaattgtgaaaaagctaaggaactggaggcatcttttgtggaactcaaaaagaaattggaaaatgagctttca

SEQ ID NO: 3024 - DNA, 1071 bp, Glycine Max
atggaagtaacagctgctccagtgccttatgtccaagaaattgcaaaggaggcattgaccatagtgcctgagcgttatgttcgaccagttcatgaacgtcctatattatctaactctacacctttacctgaaattcctgtcattgacttgagcaaattgttgtctcaagaccacaaggagcatgaactcgacaggcttcactatgcatgcaaagaatggggtttctttcagctaattaatcacggagtggactcttcattggtggaaaaagtgaagagaggtgctcaaggattattcgatcttccaatggaagagaagaaaaagtttgggcagagagaaggagaagctgagggatatggtcaactcttcgtggtttcagaggaacagaagttagagtgggcagatttgtttttcatgttcactttgccaccaaacaagaggaaaccccacttattccccaaccttcccctgccattcaggggtgatttagacgcctattgtgaagaattaagaaaacttgcaatccagatccttgaccagatggccaattctcttgcaatagacccaatggaaataagagagttatttggtgaagcagaacaatcaatgaggatgaattattatccaccatgtccccaaccagagcttgtgatgggactcaatcctcattctgatggtggaggcctcaccatccttctccaagccaatgaagtggaaggtcttcaaataagaaaagatggactgtggattccagttaaaccccttcccaatgctttcatcataaaccttggtgacatgttggaggtgatgagtaatggaatctaccaaagcatagagcacagggcaacagttaactcagagaaagagagactttccatagccacattttatagcactgctatagatgcaattatatgtccagcaccaagccttgtaactccaaaaacaccagcaatgttcaaaccaatcagcgcgggagattacttcaaaggataccttgcacaagaacttcgcgggaaatctttccttgacaccataagaattcatgctgaaaatgagaatagctcttag

SEQ ID NO: 3025 - DNA, 522 bp, Glycine Max; identical to SEQ ID NO: 299

SEQ ID NO: 3026 - DNA, 399 bp, Glycine Max
atggaagtgcatcatcatcttcaaggggttgctgataaaagcactgatttctgcccagttgaacaccctatggagccaccagatgaagatcgtcccgtgaaatgcccaatgcccgagtcttcagttatcaatgatgaaaggatgcatgaaaagaggtttgcagaaagctcaaagaaaagagtagagacaaccagggtcgtggtgaatggagaaagaacgaccaccatggacgcagagcctccagctcgaggagtaagaaagcggcatcacaccctcacacacgaaggaggagaccttgtgatgactccattaatgagaatgccacctcttcctcccctaccatcccaaaatatcaccatctttcaggtgcttcagcagttggacaagtttgagtcttaa

SEQ ID NO: 3027 - DNA, 564 bp, Glycine Max
atggaagtggaggcagtgcaacaacagcgcaaaggagcgcacctgaagaagagggctctgaagaacaaagctttgggcatcactttcaacgagaaagatctcactgactacgtcaccggctttcacaagcgcaagaagaagagaagaaaggaagcccagaagcaacagaacgaggctctgcgccgcaaacgcaccgaggaacgcaaaaggaggaagttggaaagagaacatgttcttaatggaggcgtgccaccacctgatgaaattgatggggaccaagaagaaaccgaggagcaagttgaatctattgctgaaacaaagacatacgagaatgatgatctgaaagtcactgttgtaacaagtgagatcaaccctgaggacggtagttatcctagtgagaggaaggaggcagcagtgatccctccttctgttgtgtctgataaaaggcaaggggtacctataagtaataagaaatctttcaagaaggttgcaaaacagaggtctcggccaaggccatcaagtaagagagataagaagaaaggaaagaagcagggcaagaagtaa

SEQ ID NO: 3028 - DNA, 564 bp, Glycine Max; identical to SEQ ID NO: 3027

SEQ ID NO: 3029 - DNA, 936 bp, Glycine Max
atggaatcggcattgatatttctgggaacgggaagttcggggtcggttccttgcatgaggtgtctcattgacccttcggatcctccatgtcctgtatgtgcttactctctctccttcccacctcacctcaatcctaactacaggtgcaatagctctctgttaatcgattattactgtcgaagcgatgccactcacaaatatatactgattgatgctggtaagaccttcagggagactgcacttaggtggtttgttttccatcacattcccagagtagattctattgttttgactcatgaacatgctgatgctgtccttggattggatgatgtgcttgctgtgcagccgtttagtcccacaaatgatattgatcccatccccgtttacttaactcagcattcaatggatagcgtcgaaaagaggttcccttatttggttcagaaaaaacacaaagaaggtcaagaaatgagaagggtggctctgctttgctggaacataattgctgatgattgtaatcggccattttttgcatcaggcttaaaattgattcctttgccagtaatgcatggagaggattatatctgtttgggatttctttttggtgagaaaaatagggtggcttatatatcagatgtttcacggattccagctagtacagagtgtgtcatttcgaaaagtggggctggacaggcaggacagttggatcttcttatattggatgcgttggaaaagactggatcacctaacgttcacttttgtcttccacagactcttgaaactgtaaagaggttatgtccaaagcaaaccctattgataggaatgaatcacaagtttgatcaccacaaggacaatgagtttttaatggaatggtccagaagggaaggactatcagtgcagcttgctcacgatggtttgagagttcccataaacttatag

SEQ ID NO: 3030 - DNA, 789 bp, Glycine Max
atggaatctgctatttgcctacgctattgccccattccctatggtcccaaaggatttcatggtgcaaatcctagcagatttcatctcaagattaaccatgccacccctctttctctccctcaaatttccaccaccagaagccctgttacacgttcatttgggcatgcaaattgcatgcttgaaagattctcatcagtaccctccgagaatgagggaagtggcaacaaaattttgagaggagtgacactatcttctctggttctgacatgtgttcttggattatttagttttggtggcaagaatatgaatcctaaactcaccacagcttatgcttcaccatatgataaaattgcatctttatttgtccgtgagactgaggctcaaggaagtgttgctctcaagccacggttggatggggctcaaggaagtgttgctctcaagtcactgttggaaataccgagcgatgcagaactcgcagatactcagaagaaaaggtcttccaacttcggtgagcgtggacctagccagctagaagttaacaaccttaagtggctggctatcggtctaagcaaatctccggatagaagtaaagcactgaaaacactgacagatcaatacaagtactgcaaggcgcacaagatcactggagagtcagaacagtacctggaactggctatggtagaactttccatgtttaaggtacataagatgataggattcacttcccccgcagcactgtgctcatattttccaaagatttttttttatttcactctcacactcttttaa

SEQ ID NO: 3031 - DNA, 1161 bp, Glycine Max
atggaatcttccaaccaattcaatgaatcatttaggcaaggtcttacagctggatatgtctttgctgcaacttttgtcatagtactttatatgtcctcttgtctccctgcacaacttatcaagaacaggaagaatagaacgggtggatttaagaaagcaacacagaagcgtaagttgccgcttcaggagttgaaacaagaaaaaaacaaagagaaacgaaagagagcaagacagatagacagagatcttcctgtggagttgctagagagaagaataaagatcaatgacattggatggttgacatgtagaacgagcttcgcagaactgtatgaagcaaccgaacacttcagtgaggacagtgtcattggtgagggaaggactgggacaatgtacaaggcaacacttcccaacggttggttcttgctggcagttaagaaactctatgattctgagttgtgtatcagaagtttcgatttagaaataatgatggggaggtacagtcacagaaacataatggtccccatcagtttctgcatagaagaagaaaaaaatgaaagaattttggtgtatcattacatgtcaaatggaagagtttctgattggttgaatgataccaccacattaggatggcctgcagttataaggattgcattaggtgttgcaagagggttatgctgccttcatcatagcttgcatatggttcatctcagtattggtcccgagagtatcttgttaggaaacaattttgagccaagaatatccaattttggaatggccattttcatagactatgatctagacaaaaacattggatttgataagaaggatgtgtatgactttggaactttgctttttgaggtgattagggggaaggcattcggccaaacaagtaaatgttttagcaatgctaatactaatggtccttttacaacttacacatatgctactaatctgttcgaggacccttttggcttctatgatgccgtggataaatgtctaaatgagatagaatttgaagatgaggtttctgctttactcagagttgcatgtgactgtgttcatcctttacctcctaaaaggcccacgatgcttgaagtgtatagtaagatgagcaacatatgggagagagatggcctttttgaagattcttccacgttctag

SEQ ID NO: 3032 - DNA, 231 bp, Glycine Max
atggacaacaaaattcgacctttatcagtgtcattgcattccaatttcttctcctcactaaaacaggttgaaaagaggttaaaattagaccaaactttacaaccagcaatagaatctcagatacatgaaagcattttgggttctcccatcttccttcaatctagttgtagccagaattgtccctcacaagatagcagtgaacctcctcaagcattcctctcagtttcctaa

SEQ ID NO: 3033 - DNA, 1218 bp, Glycine Max
atggacaaggacaagtctaatactcacagctttcttcacagtattgttaaacacttcaaattcggttcccctaaagagcgaaacaatgaagctgacatacagcaaatggctgcacaggagcagaagatcttcgcctacgaaaccttggcagctgctactaagaattttagtgctattcataagcttggtgaaggaggctttggacccgtctacaaggggaagctgaatgatgggagagagattgctgtgaagaagttatcacacacttcgaaccaagggaagaaggagttcatgaatgaggcaaagttgttggctcgtgtgcagcatcggaatgtggtgaatttggtgggctattgtgtccatggcaccgagaaactacttgtttatgagtatgttgctcatgaaagcctagacaaacttctattcaaatcacaaaagagagagcagcttgattggaaacgtaggattggaataatcacaggcgtggcaaaggggttgctttatcttcacgaagactcacacaattgcatcatccatcgcgatatcaaggcgagtaacatcttgcttgatgataaatggacgccaaagattgcagattttgggatggctcgtcttttcccggaagatcaaagccaggtccatacacgtgtggctggaaccaatgggtatatggctccggaatacgtgatgcatggaaatctttcggtgaaggcagatgtatttagctatggagttttggtattggagttgatcaccggccaacgaaactcttcttttaatttggacgtggatgcgcaaaatctgcttgattgggcatacaagatgtacaagaaagggaagagcttagaaattgtggattctgcattagcatctacgatagtagccgaagaagtagcaatgtgcgttcagctgggtctgttatgcactcaaggcgatcctcagctacgtcccacgatgaggcgcgtggttgtgatgctgtcgaggaagccagggaacatgcaagaacctacgagaccaggagtaccaggttcaagatacagaagacctcggagacactctgcattgtcttccacagtgggtacctctggtgcctctgattcacacacttctgattctagtaataattataataccacggttactactagtgccacggggactatctcagctactgcagaaacagacccaaaagggaaacgtccaattcgggagggttag

SEQ ID NO: 3034 - DNA, 1308 bp, Glycine Max; identical to SEQ ID NO: 300

SEQ ID NO: 3035 - DNA, 783 bp, Glycine Max; identical to SEQ ID NO: 301

SEQ ID NO: 3036 - DNA, 564 bp, Glycine Max; identical to SEQ ID NO: 302

SEQ ID NO: 3037 - DNA, 834 bp, Glycine Max
atggaccaagcaataagcaaaggcagtggtgagattttgaatcatgttgatgaaagggtggatgaggatttgaaccaattggttgaaggaaaagcaattgatgcaggagctggacatagcttgggtgaaggagttagtgtaagtggagaagatgggacttcagaagagatgtgcaatgatcttagattgaagaaagagctaaaggagggacctcaagaagttaatgatcagaacatgggtgacccacaagaaattaatgatacattgcatggggttgatcaaggaactagttatagttcaagagatttggttagtggggaagtacctgagacttgtgttgttatagatccttttactcagattgagtgtgtcaatggagataataggaaattggaagcaaaacctaaggaatcaggcgagaatttggaaggtgaaatgatttgtaggatttgccatctggcctctgggcaacgattggaagcagcagatgttggcactgcaagtagtgctactactaatacagatttgattcagctcggttgtgcatgtaaagatgagctagggattgtgcatagtcattgtgctgaggcatggttcaagcttaaaggaaacaggttgtgtgaaatatgtggtgagactgcaaaaaatgtttcggatgttacggataatggatttattgaagagtggaatgatactagattcatggacagtgataatacctcatccagaaggtttggtggatgcttgtgcggacaaccattttgtaacttcttaatggcatgcctggtaatagcttttgttctgccatggttcttccgtgtaaatatgttctag

SEQ ID NO: 3038 - DNA, 1242 bp, Glycine Max
atggacccaacttcgatccctccccctccggccaccaccgtccccttcactgtcgaacccagcaatcacgtgacccccgccgacaacaccaacaccaaccaccctccttacgatgagatgatatacacagcaatcggggctctgaaggagaaagatggttcgagcaagcgagccataggaaagtacatggaacaagtgtacaaggaccttccacccacccactctgctttgttgactcaccatctcaaccgattgaaatccgctggtcttctcatcctcgtcaaaaaatcctacaagctccccggatctgatcctcttcccgtgctccaggcccaaaagccccgcggtcgccccccaaagctcaaatcccagcccaacactgagctcacatggcctgcgctagccctcaacgacaaccctgctcttcaatccgcaaaaagaggcccgggtcgtcccaaaaagattgcaggacccgtaggtgtgagcccgggcccgatggtgccgggcagaaggggtcgtccacctgggaccgggagatctaagctgcccaagaggcctggccgtcctcccaagcccaaatccgtgtcggcgatctccagtgggctcaaacgacgtccgggccgcccacccaaagccgaatccaacgtaaacgtcatccccttcgcagcccctgttgctcccggcctgcccacagtgcagcccatcgttcctactgcttccgtgcccaatggatctcccaggcccagaggaaggcccaaaaagattgttgccggtgcgggggctccggcgctctcttccgttggtggtgcaccacgtggccgcggacggccccgtggggtcttgccgttggtgaggccgggccgccctcagaagctcgccgttggaaggcccaagaatcctgcaagaaggcccgtgggccgccccaagggatcgacagctgctgcaatcacagcacataaggctgctaatgatgatctaagaaggaagcttgaacacttccaatcaaaagtgaaggagtctcttggcacgcttaagccttattttaaccatgaaagtccagtcactgcaattgcggcaattcaagagttggaagtactgtcaactttggaccttaaagcaccattgagggatgagacccatcaacagccacagccacagccacaggtgtatgaacagcaatatccccagccacagccactgctgcagcaattttttcaaccacatacatcagccccaagctag

SEQ ID NO: 3039 - DNA, 1464 bp, Glycine Max; identical to SEQ ID NO: 303

SEQ ID NO: 3040 - DNA, 1269 bp, Glycine Max; identical to SEQ ID NO: 304

SEQ ID NO: 3041 - DNA, 1269 bp, Glycine Max; identical to SEQ ID NO: 304

SEQ ID NO: 3042 - DNA, 1461 bp, Glycine Max
atggaccgacccgccgccatattttccgacaccgtcaacctcaacggcacggtgacgcagctgtctctgctcgccgacgggaggctgtggtggccggagggcggtcaacgcaatttgagcatcgagaaagaggttctcgggttcaccggcgacggtcccgatataaggctcaaaacaatcgtggaaaccgaagatggatgctgtggcggtgcaagcagagcaaaactagtccgaaacgacgtcgtttttcggccatcgtccgaggaaacgcataggctctggtgccagaagcttggcgaattcatcgattctctcggacgacccaagaggctttttgtttttgttaatccattcggggggacgaaatctgctgtcattgtttttcgtgatcaagtcaagcctctgcttgaagacgcacaagtgcagcttacagtccaagaaactaagcatcagctccacgcaaagcaagttgttcagtcattagatttttcaaagtacgatgggattgtttgtgttagtggagatgggatcttggtcgaggttgtaaatggactgcttcagaggcaggactgggacactgcaattaagatgccccttggagtagttcctgcaggtacgggaaatggcatggcaaagtctcttcttgattcagttggtgatccttgtacagtacccaatgctgttcttgccatcatacgaggccgtaagcgaaaacttgatgtggccaccatcacacaaggggagaccagatttttcagtgtgttgatgcttgcatggggtctggttgctgatattgatatcgagtctgaaaagtataggtggatgggaagtgctcgtattgatttttatgctctcactcgaatcttgcatttgaggcattacattggatgtctttattttgtgcctgcacctggatttgaagcttacggggaccccactagttaccctggaagttctaataacaaaggcagcaatagtgaactaattgatgaggaacctttgaagttacaaaggctaggctatcaaggacctgaaattgacctggagaatcagagttggagagttttaaatggaccatttatttctgtctggcttcacaatgtggcttggggtgctgaaaacaccaaggcagcaccagatgcaaagttctcagatggttatctggacttgatcattacgaagaattgcccaaagttaccattgctgtcgttgatgtcagatttgaataatggaggtcatgtaaaatcaccatatgtcatgtatttaaaggtgaaagttttggtcttggaacctggtccacgcttgggggaccaagagaaggaagggatcatagatgcagatggtgaggttctggcaagggggaaagggtcgtaccaatgtgagcagaaggctttgatggcctatgataaacttcaaataacagtagatcaaggtttagctactattttttctccaatataa

SEQ ID NO: 3043 - DNA, 1353 bp, Glycine Max
atggaccgacccgccgccatattttccgacaccgtcaacctcaacggcacggtgacgcagctgtctctgctcgccgacgggaggctgtggtggccggagggcggtcaacgcaatttgagcatcgagaaagaggttctcgggttcaccggcgacggtcccgatataaggctcaaaacaatcgtggaaaccgaagatggatgctgtggcggtgcaagcagagcaaaactagtccgaaacgacgtcgtttttcggccatcgtccgaggaaacgcataggctctggtgccagaagcttggcgaattcatcgattctctcggacgacccaagaggctttttgtttttgttaatccattcggggggacgaaatctgctgtcattgtttttcgtgatcaagtcaagcctctgcttgaagacgcacaagtgcagcttacagtccaagaaactaagcatcagctccacgcaaagcaagttgttcagtcattagatttttcaaagtacgatgggattgtttgtgttagtggagatgggatcttggtcgaggttgtaaatggactgcttcagaggcaggactgggacactgcaattaagatgccccttggagtagttcctgcaggtacgggaaatggcatggcaaagtctcttcttgattcagttggtgatccttgtacagtacccaatgctgttcttgccatcatacgaggccgtaagcgaaaacttgatgtggccaccatcacacaaggggagaccagatttttcagtgtgttgatgcttgcatggggtctggttgctgatattgatatcgagtctgaaaagtataggtggatgggaagtgctcgtattgatttttatgctctcactcgaatcttgcatttgaggcattacattggatgtctttattttgtgcctgcacctggatttgaagcttacggggaccccactagttaccctggaagttctaataacaaaggcagcaatagtgaactaattgatgaggaacctttgaagttacaaaggctaggctatcaaggacctgaaattgacctggagaatcagagttggagagttttaaatggaccatttatttctgtctggcttcacaatgtggcttggggtgctgaaaacaccaaggcagcaccagatgcaaagttctcagatggttatctggacttgatcattacgaagaattgcccaaagttaccattgctgtcgttgatgtcagatttgaataatggaggtcatgtaaaatcaccatatgtcatgtatttaaaggtgtggtcatcactgtgcctcaagtttaatactttttcctgctttgatttatttgcacaagatatgttactttgtgtatcttga

SEQ ID NO: 3044 - DNA, 309 bp, Glycine Max; identical to SEQ ID NO: 306

SEQ ID NO: 3045 - DNA, 291 bp, Glycine Max; identical to SEQ ID NO: 307

SEQ ID NO: 3046 - DNA, 6456 bp, Glycine Max; identical to SEQ ID NO: 308

SEQ ID NO: 3047 - DNA, 6456 bp, Glycine Max; identical to SEQ ID NO: 308

SEQ ID NO: 3048 - DNA, 942 bp, Glycine Max
atggacgacgcctcctcctctccccctcctcctcctccccctcccgatcccccctccgccgtccccctctccctcgtccccctccccgccccaccctcctccactcgccgcctcccccctccctgctggtcccccgatgaaaccctcgccctcatcgacgcctaccgcgacaagtggtactccctcggccgcggcaacctcaaggccacccactggcaggaggtcgccgacgctgtctctagccgctgccccaacgcctcccctcccaaaactcctgtccagtgccgccacaaaatggagaagctgcgcaagcgctaccgcaccgagatccaacgcgctcgctccctccccgtttcccgattcaactcctcctgggcccacttcaagctcatggactccatggaaaaaggcccctcccctgttaaacccgatatcaacgattccgatcataataatactgataacgatgacgatgacgatgatgctggtcaagatctctaccaccaccagatcaaccacaacggccacaccagaagcttgaacaagctctataggaacggctttccaggttccggtggtggtgccggtgggtttaggattcgaattcccactgggttgagcgcgccgcagcagcagcatcctggatctgcttccaaggtgtttgggaaggttgggaatcagagattcagccccaatttgaatcaaaaccctaaccctaatcttgggaagaagagggagagagaccccgtgggtgaagtggtggctgcgattaaggtattgggagatgggtttgtgagaatggaacagatgaagatggagatggccagggagatcgagaccatgcggatggagatggaaatgaagcgcactgagatgattctagaatcgcaacagcggattgtcgaggcatttgccaaggcctttccatgtacaattggctaa

SEQ ID NO: 3049 - DNA, 834 bp, Glycine Max
atggacgccgccggcttagattccgatggccgtgaattcaaaacccccgaggacatgtggagggaacaggcgggtgaccctagcaagaagacccagtggtatcgcgacggcgtctcctactgggagggtgttaaggcaaatatggatggggtattgggagggtttgcaaatgtgaacgagcctgacataacttgcagtgaggatttcttgaacattctcttctctgaacgttttcatgctgctgatgccagacaccaaccacttgttgttcttgattgtggttctggcattggcagagtcaccaaaaatctgttaataagatacttcaatgaggttgatcttctggagccagtatcacatttcttagagactgcacgtgaaactttggctctaggatgtcagacaaattcagatatgcacaaagcagttaatttttactgtgttcctcttcaggattttacaccagatactgcaagatatgatgtaatatggattcaatggtgcattggtcatcttacagatgaagattttgtttcatttttcaagagagccaaggttggcctcaaaccaggtggattttttgtcctgaaggagaatattgccagatctggatttgtgcttgataatgaagaccgaagtgttacaagatctgatttgtacttcaaagagctattttctcgatgtggattgcatgtttacaaatcaaaggatcagaaaggattccctgaagaattatttgctgtgaagatgtatgcattaactacagaccctccaaagaaggctccccgagcaaaatccaaaacatcaactaatagacctagaactattatgtga

SEQ ID NO: 3050 - DNA, 3951 bp, Glycine Max; identical to SEQ ID NO: 310

SEQ ID NO: 3051 - DNA, 1047 bp, Glycine Max; identical to SEQ ID NO: 311

SEQ ID NO: 3052 - DNA, 1377 bp, Glycine Max
atggacggcgggaaccgaccggaggcggagcgctggctatacaccgccaacaagctcctgagcgcgcgtgacctgcacggtgcgcgctccttcgccatccgcgcgcgtgagtcggacccgacctacgatgcctcggagcacctcctgacggtcatcgacacgctcctcgccggcgagtcgcggatcaacgaccaccaccgcgactggtacgggatcctccagattctccgctacgccaccaacatggaccacatcgccgcccagtatcgccgcctcgcgctcctcctcgaccctcaccgcaacatgttcgccttcgccagccacgccttctccctcgtcaacgacgcctggtccgttctctccaattccgccaagaaagccatgtacgacagcgagctccgcttgctcaccgctccggcgccgccgcaacatcatcctcttcccccgcagcctcaacccacgccgaggcgaaaccctagatcgagggacgagccgaatcctaaccgtcccgagtcggctgagtcgagtcggcagactcggaccgtggaaactgatacaggaacaagtttctggacctcgtgtccttattgttatgtgctgtatgaatatcccaaggtttatgaggagtgtaccttacggtgccagagttgtcggagagggtttcatgcggtggtgatacggtcgccgccgccgttgagtgggaaagacggttcttattgtagttgggggtttttcccgttagggttttctgggaattcgaaggatgtgaacgggcatgcctcgaattggaacccgttttcgcctttgtttccttgccccttgaaggggtcgtccaaaaggaggcctcagaggaactgggcttactatgacgacgatgctgcggccgcgtttatagagttgtcggacccgagtgacgacgattccggtgatggggactggagggttgggaagaatagggggaggaagaggactagagggaagaaaaattctggtgatggtaggagggagcctgtggagagaactaggaggggtgctcatgtaggaaatgataatgtgggttctggtgctagtggtaatgttaatgctaatgctgcctctgctgtgctggctggtgcgaggggggagtctagtaagaaggctgcattgggtggtttgaggaggcggggggcaggaaacttggggaagttggatttgaatgtggagtttagcaatgaggtggaggagccttcccgtggagtgcacaaccgcgaagggaatgctgctggacatgctgaggataatattgaagggattgggttttttgaaggccttgatgagttcctcagtagcttgcccattctcaatgttgtggcagatgataaggttaagggtcgttag

SEQ ID NO: 3053 - DNA, 1434 bp, Glycine Max
atggacggtgcgccacaatccgccggtggtccggcgccgttccttctcaagacctacgagatggtggacgatgcctccaccaacgacatcgtttcttggagctccaccaacaacagcttcgtcgtgtggaaccctcccgagttcgctcgcctccttctcccgacctatttcaagcacaacaacttttccagcttcatccgccagctcaatacctacggatttagaaaaatacatccagagcgatgggaatttgctaatgatgagtttctgaaagatcagaagcatcttctcaagaatatacatcgcaggaaacctatccacagtcatagtcatcctccaggttctcttgtagatccagaaagggcagcatttgaggaagaaatagacaaactttcccgtgagaaaaattctcttgaatccaatattcgtaacttcaaacaacatcagtcaacagcaaagcctaagctagaagattttctgcagcgattagatggtgttgacaagaggcagaaacaattgctgaacttctttgagaaggctcttcagaatcctactttcgttgaacatctttcacgcaaaattgagtccatggatttatctgcatataagaaaaggagattgcctcaggttgatcacgtgcaaccagttgccgaaagtagcttggtggacaatcatagcaattttagaatggaatttggaaatgttttccggcaagatttttcgaataaactcagactggagttgtcacctgctgtttcagatatgaacttggtatcacgtagcacacagagttcaaatgaagatggggaaagctcacagaaaaagctgtctgaagtagaaccaagaggagtgcagacaagaacagctcttacatttgcacctgaaacattagagcttgcagatactggggcttcttttacttttaagatggattcatgtttatcacgaagagcaacaactgctgagagctcaaaactgatctctttggagccaagtagtgaagaaggcgatagtttatcctgccaactaaacttaactctggcatcttgtccattgcaagtgaacagaaattcatactcagccagatcaccccaaattgactgtcaagaaattggaaaattggcagaatcaagattttttgccaatggtaaagaatctgatagtggtgtttcctcaaacctaaatgtagctgctgaggctaccaatttagcttcatcacaggaggctccaagtaacaaccaagttaacccagctcctccagacagggtgaatgatgttttctgggaacagtttcttactgaaaggccaggctgttctgacaatgaagaggcaatatccaactaccgagcaaacccatatgatgaacaagacgaaggacggtcaactcatggaatctctagaaacattaagaacatggatcaactcacactttga

SEQ ID NO: 3054 - DNA, 1215 bp, Glycine Max
atggacgtcgcagtcactgccttccggtcaccgctgatcatcctccgaagaccggtcaacgagtctgcctcagctcggttcggttccacttttgggttttccagaaagcaacggttcagttcagtatgtatccccaaacacaagcacaagcaaggtcgtagaagagggtttgtagttagagcttctgcatcctcatctccggagtcggatgatgccaagattgctcctcttcagtttgaatcctcaattgggcagttcctttctcagattttgaaagatcatccgcatcttgtgcctgctgccgttgaccagcagctccagcaactccaaactgaccgcgatgctcatcaacaaaacgaacaaccttctgcttcaaccactgatttagttttgtacaggagaattgctgaggtgaaggctaatgaaaggaggaaagctctggaagagatcttgtatgcattggtagtgcagaagttcatggatgctaatatttctttgataccctctgtaaccccagatctttctggtaaggttgatttgtggccaaatgaagatggtaaacttgagctgcttcactcacacgaagcatatgagatgattcaaaaccacctggctctcattctcggtaacagagctggagatttaacatcaatagctgaaatcagcaaattcagggtagggcaggtctacgcagcatcagtgatgtatggttattttcttagacgagttgaccaaaggttccagttggagaagacaatgaaagttcttccaaatgcaacagaaaaagagaatagtgctcatcaaactacaatggacaatgcaagacccagtattgaagaggacacttctcaagtgatgtctcatcctgaagtatctacctggcctggtggtgatgtccgtcccggtggatttggctatggtgtaaaggcaaccaggttgcgtaactacgtgatgtcctttgatggtgatacactacaaagatatgcaacaattagatccaaagaggctgtcagcatcatcgagaagcacacagaagcattgtttggaagacctgaaattgttgtaacacctgagggggcagtctctaaggatgaaaacatcaaaattagctttggtggtttaaagaagcttgttttagaggctgtgacatttggttcttttctctgggatgttgagagctatgtggactcaaggtaccattttgtgttgaactga

SEQ ID NO: 3055 - DNA, 1161 bp, Glycine Max; identical to SEQ ID NO: 312

SEQ ID NO: 3056 - DNA, 1314 bp, Glycine Max; identical to SEQ ID NO: 313

SEQ ID NO: 3057 - DNA, 276 bp, Glycine Max
atggacttatgctcacacacaagtgcatgcaactctcatgaaaccaacatcacatcgctgacacgccgagaggagatcgaggttgcggaggccgacgtgaacatggatggtgacaatggagaagtccttcaggcaagggagagaccaatgttggtcatggtggaggtcttgcccatgcctcccttgccagaggtgatgatggcaacccaaggggtggagccagagagctcgagcttgcagttccgctggaggagggaccgaaggagaggggaatga

SEQ ID NO: 3058 - DNA, 1653 bp, Glycine Max; identical to SEQ ID NO: 314

SEQ ID NO: 3059 - DNA, 1623 bp, Glycine Max; identical to SEQ ID NO: 315

SEQ ID NO: 3060 - DNA, 1500 bp, Glycine Max; identical to SEQ ID NO: 316

SEQ ID NO: 3061 - DNA, 1590 bp, Glycine Max; identical to SEQ ID NO: 317

SEQ ID NO: 3062 - DNA, 555 bp, Glycine Max; identical to SEQ ID NO: 318

SEQ ID NO: 3063 - DNA, 1650 bp, Glycine Max
atggagaaccaatcctcttcaaacaagatagaaactcttcccatcgacactacatttaagcttccagcaaatataccagtttggccacaaggtggtgaatttgctactggaaccatcaacataggagggctaaaactgtttcaaatttcaatattcaacaaagtttggaaaaccctagaaggtggaccaggtgatgcaggggcaactttctttgagccagcaggagtacctgaaggattctttaccttaggccactacagccaacccaacaacaagcctctttttggatcaattctggtggcaaaagatgaatcatcatcttcaggtgataacaatggagctttgaagaaaccagttgattacacactggtgtggagcagcaagtcccaaaagatcaagcaagacaaagatggctacatttggctaccaacagcacctgatggctataaaaccttaggccatgttgtcaccaccacacctgagaaaccctcacttgacaaaatcaggtgtgttaggtcagatctcacagaccagtgtgagagaaactcatggatttggggaccagccaagagcagtgatgagaaaggtttcaatgttcatgaagtgaggccaagcaatagagggactcaagcacctggtgttcttgtaggaacattttttgctcataattgtgaagctccttcccctctccctattgcttgtttgaagaacaccagcatgaacttctcctcctcaatgcctaatttgccccaagttagggcactagtccaagcttattctccattcatgtacttgcatcctgatgaagatttccaacctgcttccaccaagtggtatttcacaaatggggcattgcttgttaagaaaggagaagagtccaaacctgtggcaatagaccctacaggctctaaccttcctcaaggtggcaacaatgatggtgagttttggttggaccttccttctgacaaagccaacaaggagagggtgaaaaagggtgatttcaagagttgccaagcctatgttcatgccaaaccaatgtttggtggaacattcactgaccttgtcatgtgggttttctacccattcaatgggcctggaacagccaaagtaggactcatagatatcccactagggaaaataggagagcatattggagactgggagcatgtgacactaagagtaagcaacttcaatggagaactaaaaagggtgtatctctcacaacacagcaagggccaatgggttgaggctcctcaacttgagttccaaagtgggaacaaagcagtgtgctattcctccttgaatggccatgccatttatccaaaagtaggacttgtcatgcaaggccttgatgggattggaataaagaatgaaactaagaggagtgagaaggtgattgacatgggggtgggttttgaggttgtttctggtgagtatttggggtcagcaattgtagaaccgccttggctaaactttttcaggcaatggggtcccaaaatcacctatgacattgcaaaggtgttggacaagttggagaaggttttccctgctttgcaaggccttgaagatagtttgccaaaagagttgttgggagaggagggacccacaggacctaagctcaaaagaaattggagtggtgatgaggtttga

SEQ ID NO: 3064 - DNA, 1100 bp, Glycine Max
atggagaacgagaaaattccatcagtttatgaacatggtagctgtagcagaagtgctgaacctgaacctagacctaatgattcccgtattctgggaagaaaataccatttatactgggcgctgggtttcggaagttccgccattgtgaagcttgcaagtgacgttaccaccggacacggcgtggccatcaaaattttcgacaaggaattcattgacggaaagaaaaaatctgtcaagaaacgaatgaaaatcgcgcttgaacgagaaatatcagcaatgacaatgcttagatcacaccctaatgtcgtgcgtataattgaggtgatggctaccacgacaagggtgtatattgtaatggaacttgtagttggtggtgcaacactgcttgataaaattggacgaacttcgggaatgtcagaaacccaagctagacagtattttcatcagcttatatgtgctgtggattactgtcacagtagaggtgttatccatagagacctgaatccgtcaaatttgttgcttgctgctgatggagtgcttaaagtgtcagattttggaatgactgcactgcctcaacaagctagacaagatgggctgcttcactcagcatgtggtgcgcttgattataaagccccagaggtgataaggaaccggggctatgagggtgaaaaggctgatatatggtcatgtggtgctattctgtttcatttagttgctggtgatgtgcccttcacaaatgctgacttcatctgtccctcatttttctctgcaagtttagtagcactgattaggagaatccttgatcccaatcctactacacggattacaatgaatgagatctttgagaatgaatggttcatggagaattatgagcctcctagattttacaggcaaaattttacttttggtcatgattcacaaaagcgtgttgctaaggggcatggagcagggtcttcagcaccaccagtgccagtcatgaatgcgtttgagattttgaatacatttctgggctactaccttattattggaaagcttttaaaccagctggtatacagagagtccttcaatttagttagaagtctttcaaaagtcttgacata

SEQ ID NO: 3065 - DNA, 1329 bp, Glycine Max
atggagaactatcagtacccggcgtcgtaccctgactccggcgagtcctccccgcgctcgcgcgagatcgacttcgagaacccgccgccgtgggacgagcagcagaaccaaaactacaaggccaagttcatgtgcagctacggcggcaagatccagccccgcacccacgacaatcagctctcctacgtcggcggcgacaccaagatcctcgccgtcgaccgctccgttaagttctccgccttcctctccaagctctccgccctctgcgactccccgccacaggacctcaccttcaagtaccagctccccggcgaagacctcgacgccctcatctccgtcaccaacgacgacgacctcgaacacatgatgcacgaatacgacagactctatcgccctaacctaaaacctgttagaatgagactcttccttttcacactctctaattcaaaccctaattcctctttctcctccgaacgcgaccgtttcgttgaggctcttaattcgggtccggttccttctcaacccgatccgatcaaaaccccacccgttacgccttctaatgttgattatctcttcggtctcgataaagccgttgctcctccaaatcttcctccgaacttcgcagcggttaaattccacgatccggtgccggaacctgtcgctccgacgccggtagagtatcaatcgagagtttccgatcgggttgttggatcggatccgaatgtgaattcgatggaaattcagagacagatgcagcaggagatgcagcgattgcagattgcggagaatgaatatcgtagaaggaccggaggagattattacatgcagaaggtgcaggagaaggttccgccgcagaatgcggcggtgccgcctccggcggcgtactggtcggagaagcagttttccggggagggatatcagacgacggtgacgacggcggctccgggaggaggtgaccagccgatgtatggatactacgctgtgcagaggatgggttctgatggctaccgtgaacagcaggcggtgtacggaggcatggctgcgccgaaagcggggttttcgacggcggggatggttaaggggccggcgtattcggagggatatagtggcggcgtggtgaggccggcggggttgccggataatgcggcgtatgcgcaggtggcgtatgatagcgcgagtgggagacaggtttactatactgcgcagggaggagtggtgcacgcgccgccgcagtaccaggggggtccgcctcaggatgtgaggccgggtggggtttcggtggggcaggatggtaaggtggttaacaaggttaaccaaggttctgtgtga

SEQ ID NO: 3066 - DNA, 204 bp, Glycine Max; identical to SEQ ID NO: 319

SEQ ID NO: 3067 - DNA, 735 bp, Glycine Max
atggagaagaagagatttggtgtgttgatgtgcgcagaggattcagagtacgtgaagaaagtgtacggaggatattctggagttttcgtgagaatgctggcggaggagggagagacatgggacgtgtacaaggtggcgtgtggggattttcctgatgaagatgacttgggtctctatgatggctttgtgatcactgggagttgcagtgatgcacatggcaacgacacatgggtgaatgatctcctcaacttgctccgcaaactcgattccatgaacaagaaaatcctcggaatttgcttcggccaccagatacttgggcgtgcattgggagggaaggtgactcgttctcctactggatgggaccttggtgtcagaaccataacactgtcaccatctttgccatttgctttgatttctcttgatcttccatcaaggctttccattatcgaatgccacagggatgagatccgagagctacctgccaaggcagaggtgattgcttggtcggataagactggaattgaaatgtttaggtatggagatcacattatgggaatccaaggtcaccctgagtactccaaagacattctttttcaccttattgatcgtctcattcaacgcaattacatcatagatgctttcggtaagcaagcaagggacagggctgcattgtgggagccagatagggaagcttggaagaaactctgtgtcacttttttgaagggtcgattgtga

SEQ ID NO: 3068 - DNA, 2187 bp, Glycine Max
atggagaagagcgtgagggagttgggagtgcaggacttggtgaatgcaggaggtttaacacttgcagaagccaatgaattataccatgttttgactgatattctgtctcagtctcagtctccctcacacatatggcaccaaattgtgactcggagattgctcaaaccatccttcccacactctttgcatcagcttctctattactctgtttatcactctgcttttcattctcaacatgcttccctcccacactattggttcccttctatagagcaatccaaacgcaccaacctgggccgtctcatggaaactcatgcccctaaacttttaggagcttcctacaaagaccccatcaccagttttcatctctttcacaagttctccgttcaacaccctcaggtgtattggtcccttattctcaaggaactttcagtttcctttgttgagcctccaaagtgcattttagatacttcttctgacccttccaaacatggagggacttggcttcccggttctgtcctcaacattgctgattgctgtttgcaacccactccatacccccacaaaacagatgacactttagccgtcgtttggagagatgaaggtttcgatgattccgaggttaatggtatgactctcaaacaactccggcaccaagtgatgttggtagcaaatgcaatagatgccacattctcgaaaggagatgcaattgccattgacatgcaaatgacagtcaatgctgtgattatatatctagccattgttctagcaggatgtgtagtggtatcaatagcagatagctttgcaccaaaagaaattgcaactcgtctgcgtgtttctaaagcaaagggtattttcactcaggatttcatatcaagaggtggcaggaaattccctttgtacagtcgagtcattgaagcagctgcatgtaaagttatcgttctgcctgtgataggtgatgatctaggtgtgcaattaagagattgcgatatatcatggaaggtttttctttcttctagcagacagcatcccaggtcacatcactactctccaatcattcaatcaattgatactgtcactaacatacttttctcatctggaaccacaggggagccaaaagcaattccttggactcaactttcaccaatacgaagtgcagcagatgcatgggctttcattgatattcaacctggagatgtctattgctggcctacaaatttgggatgggtgatgggcccaactcttatatattcatgctttctgtcaggtgcaactcttgctttgtatcatggatctcctctaggccatggttttggaaagttcgttcaggatgcaggtgttactattttgggaacagttccaagcttagtaaaaacttggaagagtacacaatgcatggaggggttggattggacaaaaataaaaatattttgttcaacaggagaaacttcaaatgttgatgatgacctctggctttcttcaaagtcttattacaaaccaatcattgaatgttgtggaggcactgagcttgcatcttcttacatcatcggaagtccactgcaacctcaagcttttggagcatttagcacagcatcaatgacaactggtttggtcatccttgacgaaaatggagttccttatccagaggatgttgcttgtgttggtgaagtgggcttgtttccaatatatatgggagcaactgatagattgcttaatgcggataatgaggaggtttactttaagggaatgcccatatacaaaggaaaggttcttaggagacatggagatataatcaaaagaactgttggaggccattttgttgtacaagggcgggctgatgacacaatgaatattggtggaataaagacaagttctgtagaaattgagcgtgtctgtgatagggccgacgaaggcattttggagacagctgcaatcagtgttgctcctgcaaatggaggcccggaacaactggttatatttgcagttttaaagaaaggatacaattccaatgcagaaactctaaagaggaaattcagtaaagccattcaaagcaaccttaatcctttgtttaaggtgagccttgttaaaattgtgcccgattttccccgaacagcttccaacaaattactaaggagagttttgagagatcaaatgaagcgtgagctatcaattcagagcagactttag

SEQ ID NO: 3069 - DNA, 2838 bp, Glycine Max; identical to SEQ ID NO: 320

SEQ ID NO: 3070 - DNA, 222 bp, Glycine Max
atggagaaggaaaaaaaggaaaacttgtgccgcagagttgagttcgacggaaaaagaagcctctggaaagtcctaaaaatcccaaccgcagagggtagggaggacttgctaaatctgaaccagaaagagagaacaaagaaggctaataaacctgaagatctgttttctccatgtgatagtgactcatgcaaagaacataaaaacctaactaacatcagataa

SEQ ID NO: 3071 - DNA, 900 bp, Glycine Max
atggagaagggtagaaccgtggtggtgtccgctctgcagtttgcttgcaccgatgatatctcaacaaacgtcgccaccgccgagaggctagttagagctgcacataaacagggtgcgaacatcattctcattcaggaactctttgaaggttattacttctgtcaggcacaaagagaggatttcattcaaagagctaagccacataaggaccatcccacaatcctcaggatgcagaaacttgcaaaagagttaggtgtagtcattccagttagcttctttgaggaggcaaacaatgcacattataactcaatagccataattgatgctgatggaactgatcttgggatttatagaaagtcccatattccagatggaccaggttatgaggaaaagttctattttaatccaggtgacactggattcaaggttttccagactaaattagcaaaaattggagttgctatttgctgggaccagtggtttcctgaggcagcccgagcaatggtgcttcaaggtgctgagattttattttatcccactgctattgggtctgaacctcaagatggaagcattgactctcgtgaccactggaaacgagtaatgcaaggacatgctggggctaatttggtacctcttgtggcatcaaataggataggaaaggagataattgagactgagcatggaaaaagtgagataacattctatggaaactccttcatagcaggacctactggagaaatcatttcaactgctgacgataaagacgaagctgttcttattgcacaatttgatttggacaagatcaaatccatgagacattgttggggggtattccgtgataggcgtccagatctatataaggtgcttttaacattagatggcatcaatcccgtccagtga

SEQ ID NO: 3072 - DNA, 789 bp, Glycine Max; identical to SEQ ID NO: 321

SEQ ID NO: 3073 - DNA, 1083 bp, Glycine Max
atggagaatttatacaaagttgaagccacaggtaatgtgaagcctgtactgttaatgattgcggtccagacactgtatgcagtggtgaatatcatgttaaagattgtggcagatgatggaatgagcttaagtgttcttgttgcctaccggttcttctttgcttctgctttcatcgttccgcttgctctcatctttgaaaggaaaagcctgcaatatgttactgggaaagttctattccaaggtcttctttgtgggttatttgggggatccttactacaaggtttctatgttaaatccttggccttgacaactgcagtatatgtcacagccatgttgaacctcatccccgctgtcacctacatcttgtctgttactctaagacttgagaagtcaaatcttggaacagcaggtgggatgaccaagttgctggggactttaacaggaatcggtggtgccatgatcctcactttctacaaaggaagaaggctatgcctctggtcaacaaacattgccttgttgcaccgtgagccatcatcacacgatgcccccataggttctctcttgttgggctgcatactagcttttgcagccgctctgagttactctgtgtggttgataatccagacaaagatgagcgaaaagtttccgtggcactattcaattgcagctttaacctctgcaacggcctcaatcctatccgttatatttgctctttctacggagagagattggagccagtggaagcttggttgggactttaggcttctaacagcagcttctgcgggtatcttggcctctggagtgtgttacccccttttagcatggtgtgtgcgtaggaagggacctctgtttacatctgctttttgtcctctaatgttggtgatagtgaccctttccgagacattggtactagatgagtgtctcagcgttggaagtttaacaggatcagtgttaattgtggggggattgtacatgttgctgtggggtaaaagcaaggaaaaacggatggaacatagtgatatagtgtcctcaaaaggcactcttcaatgtgaagcaattcacaataccgacccatcatcttag

SEQ ID NO: 3074 - DNA, 564 bp, Glycine Max; identical to SEQ ID NO: 322

SEQ ID NO: 3075 - DNA, 564 bp, Glycine Max; identical to SEQ ID NO: 322

SEQ ID NO: 3076 - DNA, 564 bp, Glycine Max; identical to SEQ ID NO: 322

SEQ ID NO: 3077 - DNA, 564 bp, Glycine Max; identical to SEQ ID NO: 322

SEQ ID NO: 3078 - DNA, 564 bp, Glycine Max; identical to SEQ ID NO: 322

SEQ ID NO: 3079 - DNA, 564 bp, Glycine Max; identical to SEQ ID NO: 322

SEQ ID NO: 3080 - DNA, 1122 bp, Glycine Max
atggagagaatgttccctcccaagaagccctctactatgaattcccatgacagacccatgtgtgttcaaggagactcgggtcttgtcctcaccactgaccctaaacctcgcctccgttggactgttgagctccatgaacgctttgttgatgctgttactcagcttggagggcctgataaggccactcctaaaaccatcatgagggttatgggtgtgaagggtctcaccctttaccacctcaagagccacctccagaaatttaggcttggcaagcagccccacaaggatttcaatgatcactcgattaaggatggtatgagagcttcggctttagaactgcagcgaaacactgcttcctcttctgccatgattggccgcaacatgaatgagatgcaaatagaggtgcagagaagacttcatgaacaacttgaggttcaaaaacaccttcagctaaggattgaggctcaagggaaatacatgcaaagcatattggagaaggcttatcaaacccttgctggtgaaaacatggcatctgcagcaactaacttaaagagtgctattgtacctcatcatcaaggaatccctgacatgggagtagtgatgaaggagtttggttcccctcttggtttttcttcattccaagaccttgagaacatttatggaggtaaccaaattgaccttcagcagaacatggagaagccatcccttgatcatggtttcatgccaatcaatgagagcttgtgtttggggaagaagaggtccaataacccttatagtgggagtggtaagaaccctttgatttggagtgatgatctaaggcttcaagatttgggagggccagcatcatcatgccttggccctcaagatgaccctttcaaaggtgaccagattcagattgcaccaccaggatcattggatagaggagctagcactgacattgatcccatgtcagagatctatgactcaaaacctgtgcttcagagtgaagagaaaaagtttgatgcatcatctatgaagcttgaaaggccttcaccaagaagagcacctcttcagcctgaaaggatgagccctatgatcagcactggtaccatggcacaaggtagaggctcaccatttgggtga

SEQ ID NO: 3081 - DNA, 249 bp, Glycine Max
atggagagcagcttaggagacatgttggttaaggttgtggtgttcattctagttcaagccttggtttaccttatcctctccaattcatcaaacgtgttcaacaagaacatgaagaaatctaacagcttcaggccggcacgttcggtgagcattcgccggatgctcgctttgatctctgattttcctccagaagaagaaccctctccttcaccgaagggtgctaaaacaacatcacttcatcaaagttaa

SEQ ID NO: 3082 - DNA, 639 bp, Glycine Max
atggagaggaacagaacacggactgcatttcttactcagtgtcacattcttatgagaagatcttctttgcatctgtttcgtgatgtaagcaattattggttacgtctagctatgtttgttctagcagctattagtcttggcactatattctttgacgttggttcaggggcactggtctcttttgttgcttcagttctgactttcataacccttcttggtggattccttccatttgtgaaacaaatgaaggtatttcagcgtgagagattgaatgggcactatggtattgctgcttttgtcattagccacacattatctcctattacatacatggacttgaacgttgcctacacttttcttgtgtgctacttgcatgcatattgtgggttgagaacctcatggtggtggtggtttcaagtatcttccccaaccccaacacgggcatcacagtctctgtaccctatgtactatgtttccttccacaaatatgccttccaaggattgttcgagaatgagtttattggcctgaagttggctagtgatcaagatggaggtgcctacataagtgatatagaaatactaacaaagatatggcaagtggaaatgggtcactcgaaatgggttgatcttgctatcttg

SEQ ID NO: 3083 - DNA, 549 bp, Glycine Max
atggagaggagcaacagcaagaaggttctgaagtcgaggcttttgaacgagaacgttcctccattgcagatcgattcggaggaaagaagaggacgctatctccaaccaaccgctatgagtccacggtttcaacccgaggcctttgtttctccgaagtttggcgccaggaccgcgaaagcgcttcagtactgcggcaccagttcgggaggaagcagtagcttcggttctcgcggtaggttgacgccttcgccgctttcgtcactcgaaaacatggagttcgcgccgctcctgtcgcctccggtgtaccgaacgccgtctacgggggacgatgacgtcatcgtgatggatgctattctcgtgaggccagtgtccggcggaaagagcggaaggtcttcctcttcctccggccgcggctctttctcatcgtcgtcgtcgacggggaagaacgtgttcaagacggagatttgcaaagcgcgagaagaatctggtaacagtcgttacaactccaaaagccaggttcgcgccataaccacactattacgaatttaa

SEQ ID NO: 3084 - DNA, 1455 bp, Glycine Max
atggagaggtgtgacaaggtgatgaaccaacgcaacatgcatgattgtcctaaaacaggtcctggctatccttcacccctggcagccatgtctggtcccaaagagactctcctttatgtcactgctatctactcaggaacaggaagggataagcctgactttctggccacagtggatgtggatccaagctctccaacgtattcaaaagttatccataggttacctgtaccttatttaggtgatgaactgcaccattttgggtggaattcatgcagctcttgctatggagatccatcagcagttcggcgatatctgattctaccttcactggtatcaggccgcatttatgtggttgacacaagatcaaatccaaggtctccatctttgcacaaagttgttgagccagaagacatcataagtaagactggattagcttatgcacacacatctcattgtcttgcttctggtgacgtcatgatctcttttcttggagataaagatggaaatgcagcaggaagtggatttcttctccttgatcatgaatttaatttgaaaggaaggtgggagaaacctgggcacagtccatcatttgggtatgacttctggtaccaaccacagcataagactatgattagctcatcatggggtgctcctgctgctttcaccaaaggttttaacttacagcatgtctctgatggtctttatgggaggcatctacatgtatacagctggcctgggggtgaactgagacaaacattggaccttggtgagtcaggggttctacccttggaggtaaggtttctgcatgatccttctaaagatacaggtttcgtggggtgtgcattgtcaagtaacatggtacggtttttcaagaccgaggatgaatcatggagtcatgaggttgcaatatcagtgaaaccattgaaagtgcaaaactggattcttccagaaatgcctgggcttataactgattttctgatatctcttgatgatcggtttctgtactttgtgaattggcttcatggtgatattagacaatataacattgaggaccctaaaaatcctgtactgactggccaagtatgggttgggggactacttcagaaaggaagccctatagtagcaataaccgaagatggtaatacttggcaatctgatgttccagacatccagggaaataagttgagagctggccctcagatgattcagttgagtctggatggtaagcgggtatatgttacaaactcactcttcagtgcatgggataaacaattttatccagagcttgtagagaaaggatcccacatgttacagattgatgttgatactgaaaatggtggtctgaaaattaaccctaatttctttgttgactttggagctgagcctgggggtccctgccttgcccatgagatgagatatcctggtggtgactgcacttcagatatatggatttaa

SEQ ID NO: 3085 - DNA, 1071 bp, Glycine Max; identical to SEQ ID NO: 328

SEQ ID NO: 3086 - DNA, 1551 bp, Glycine Max
atggagatattatcacaaatgtggtctctgttagggttacttaccgttctccagaacgttcttccatcgcagcttctctccttgcttcattctctatacgaatctctgcaagatctactttctccgtattcgtatttcgagattcctgaattcaacggctactgcggcgtcgaactcaacgacctctaccgccatgtgcacctctacctcaacgccgcgaaccacgcccccgccgccgcgtgccgccgattaactctctcctgctcgccgtcgtcgaaccgtatctccttcgccgttgcgccgaaccacaccgtccacgacgccttccgcggccaccgcgtcgggtggacgcaccacgtggagactgcgcaggactcgctcgaggagaggcgcagcttcacgctccgtctcccgaagcgccaccgccacgcgctcctctcgccatacctcgcgcacgtgacctcacgcgccgaggagttcgagcgcgtctcgagagagcggaggctcttcacgaacaacaccaccgcttcgggctccttcgaatcgggttgggtctccgtccccttccgtcacccgtccaccttcgaaaccctagccctcgagccagaactcaagaaacagataaaaaacgacttaacggcgtttgctgacggtaaagagttttataagcgagtgggccgggcctggaagcgtgggtatttactccacggcccaccgggctcgggtaaatcaagcttaatcgcggcaatggcgaattttctctgttacgacgtttacgacttggaattaacaaaagtctctgataactccgagttgcggtcgttactaatacaaacgacgaaccgttctataatagtaattgaagacattgactgttccgttgacataacggcggatagaacggtgaaggttaagaaaagtcagggcgcgaagctgtcgttgaggagtagtaataagaagggccaaacggggtgtgaagagagtgggcgagtcacgctttcagggcttttgaatttcaccgatgggttgtggagctgttgcggtgaagagaggattgtggtctttacaaccaaccacagggatagtgtggaccccgcgctcctcaggtgcggccgcatggacgtccatgtcagcctcggcacgtgtgggacacacgcattccgtgagctcgcgcgcaactacctcggagtggactcgcatgtgttgttcgaggcagtggagggatgcatccgcagcggtggctccctcacgcctgcgcacgtgggagagatactgctcaggaacagaggggatgttgacgtggccatgagggaggtcttggcagcgatgcaggggaggatgctagtcgccacagctgccgctgatcagccggaaaatgaggaggcgtcgacggctgccggagttaggtcgccagagagcgtgctgatgatggggtcgccggagaattgggatgtgaagaggaaggaacaacatgggtgtaataatttggataagaaagtcaagtttttcgttaggttaaggtcgttgaccagatctgatcctggtagataa

SEQ ID NO: 3087 - DNA, 1509 bp, Glycine Max
atggagatcctttccttcttgtcctactctctcctctacgtttttctctttctcctcttaaagcttcttctccaagccagaaagtttcaaaacctcccaccaggtccaccctctctccccataatcggcaacctccaccacctcaagcgccccctccaccgcaccttcagagccctctccgacaagtacggccacgtcatttccctatggtttggctcccgcctcgtcgtcgtcgtctcctcccaaaccttattccaagaatgcttcaccaaaaacgacgtcgtcctcgccaaccgcccccgcttcctctccggaaaacacatcttctacaactacacaaccttggggtcctccccctatggcgagcactggcgtaacctccgccgcatcaccgccctcgacgtcctctccacccaccgcctccactcttttgccgccatccggagggacgagactcaccgcctcgtccgaaaactcgccgaggctcaagggtcggagtcgtccctctccttcgccgaagtggaactgacgtctaagttttacgacatgacgttcaacaacatcatgaggatgatatccgggaagaggtactacggtgatgattgtgatatggccgatgtggaggaggccaagcagtttagggctatggtttcggagctgctgaagctggctggggcaaataacaagaacgatttcatgccggtgctgaggctgtttgattttgaaaacctggagaagaggctgaagaagattagcaataaaactgatacgttcttgagagggctgcttgaagaaatccgcgccaagaagcagcgtgcaaataccatgctggatcatctcctcagcttgcaggaatcgcagcctgagtactatactgatcagatcatcaaaggccttgctttgggtatgctcattgctgcaactgattcacaagctgtaactttagagtgggcattatcttgtgtgctgaaccatccagaggtgtttaagagggcgagggatgaattggaaacccatgtgggacaagaccatttgttggaggagtctgacctttcaaaactcccttaccttaaaaacattatctatgagacacttcggttgtacactcctgctccattgttgttaccacattcatcttcagaagagtgcattattgggggattcaaagttccaggagacaccatagtgttgatcaatgcttggtccattcatagggaccctaaagtgtggagtgaagccacaagtttcaagcctgaaaggtttgaaaaggaaggtgagttagacaagttgattgcatttgggttgggaagaagggcttgtccaggagaaggcttggctatgcgtgcactctgcttgagtttgggattgttgatccaatgctttgagtggaaacgggttggtgataaagagattgatatgagagaggaaagtggattcactttgtctaggttaatcccattaaaggccatgtgtaaagcacgcccagtcatcaacaggcttgggaaataa

SEQ ID NO: 3088 - DNA, 1380 bp, Glycine Max
atggagatcgttcgtcctcagaatcgcagaaactcgttttcctcttccaatgacgccgtttctgctcccaccattcccctctatcgctctgctcccccactcgaagtcaggctcgaggatttcgagtccttcgccatcgatcgcctccgagttctcaaggggatttctgatggtatgtcgcgtggaaaaaaatcggaagaaatggagaatttggtaaaggacctgtggaaaatgaatatgagacatcaagacgcatctcaggttctgaacaaggatattatatcacattttgttctacgtctggtgtattgcagaacggaggacttgaggaaatggtttctttccacggaatctgcactctttcgctaccgttttcgccttctgaatgctgaagctcagagagcagtcatggaagaatttgaccttccttacaaggccgttagcaatgtggaatttgagagcataaaagagaaattgggacaagttgcacgttctatgggtcagccttcgcctactgcagatgctatcttctacaaggtaccatttgaagaagttccagagcttgttgctggacggaaggtgtttataaatcaaggatatgcatatgttgcaatgaatcagattgtttcacttgtagccacactattccgtagtcaactgtcaaaggcactaatccttacaaacagaaaatggacatcttcagttagagagcaagagaaacataggttgactcctattgtggaagccctgtcctcaagttatctgggtcctgattattctcagtcaaaagaatatgctgatatatcattaaaggacattgatcaagttgccaagagctcatttcctttgtgcatgcgtcacctatttgataagctgaaagaggatcatcatttaaagcatggagggaggatgcaactaggcctctttctgaagggtgttggcataaatctggatgatgcacttgcgttttggaggtcagagttctctaaaaaggttggtttggagaagtttgagaaacaatatgcatacaacatacgccataattatggaaaggaagggaagagaactgactacactccctattcttgtcaaaagattatttcatcaactcctggagctggagatcatcatggttgcccttatcgaaatttcagtgaagagaatctaagagctgctctcagcagaatgggggtaaacagttgggcaatggaagatgtgatggacaaagtgaaaaatagacattatcagttggcttgcaccttgacatttgaagctcttcatggcatgacgtgtgatgcagggattaaccatccaaatcaatacttcagtgacagtcaaaagatattaaagccaaagagttcagcaatacccgttggttag

SEQ ID NO: 3089 - DNA, 951 bp, Glycine Max
atggagatgacaatgtcagcagcaacttgttccaacatgactagattcagtggcattctccggacaacatgtgtatcatcatctcccaagaggaagcatgcaaaaggaatcttgagaaattttaccatatgtgcctcaccatttatatcttcagttgaccctataattgttaattccccttcctttcaagttttggcttccaatctttcgcttgccgatgtcccccaacggtcagaggagtggtttgcccttcgcaaggacaaacttactaccagcacatttggcactgcgttgggcttctggaaagggagtcgtcgccctgagctctggcaagagaaagtgtttgcatcagaggcacaaatcatgggagcaaataatgccatggcatggggaacactcaaagaagcagtagctgtagaacaatataaaaagatcacaggtaatgaggtgagctcaatggggtttgcagttcattcaaagcagtcttgtgattggcttggtgcctcccctgacggtgttcttgggtgccccccacaacttgggatactggaagtcaagtgtccatataacaagggcaaacctgaggctggcttgccttggtcgaaaatgcctttctactacatgcctcaagttcagggccagatggaaataatggattgtgaatgggttgatttgtattgttggacgccaaacggaagtactatatttcgcgtgcttagggagcgtgagtattggaacttgatacatgatatgctacgcgagttttggtgggaaaatgtggttccggcaagggaagctctacttctgggtcgtgaagaagaggtgaaatcatataagcctgcatctactcaccaaaagacaggggtagcaattgctaaaagtataaaattagctcaggaaacaaagctattttgcagagaacttgcaggccatgttgaattttatagctga

SEQ ID NO: 3090 - DNA, 1761 bp, Glycine Max
atggagcaaccacaactcttgcatgacccaaatttccctctcttcaaaaccccttcttcacccgccgtaaccaccaccgccactcacaaacccctttcaaccacacccatcaccaccacctccaacggtgagcgtcgagaagaccactccgtcgaaaccgccgccaccgttgccgccgacgcggaggcgttcggcgacctcgggctggcggaatgggcggtgaagacgtgccgggagctcgggatgcggaggccgcgccccgtgcagcggcggtgcatcccgcgcgtgctggagggccggcacgtgctgggcatcgacgagacagggagcgggaagacggccgccttcgcgctcccgatcctgcaccgtctcgccgagcatcccttcggcgtgttcgccctcgtggtgacgcccacgcgcgagctcgccttccagctcgccgagcagttccgcgccctcggctccgccgtgcacctccgcatcacggtggttgtcgggggcatggacatgctcaggcagaccaaggagctcgccgcgaggccgcacctcgtcattgccacccccgggaggatccacgccctgctccgcaataaccctgatattccccccgttttctccagaactaagttccttgtcttggatgaagcagatcgtgtcctggatgttggttttcaggaggaattgagatttatctttcagtgcttaccagaaaatcgacaaaacctgttcttttctgcaacaactacaagtaatctgcaaaagttgcgtgaacgttaccaagataagatgtatgtctatgaggcttatgaaggttttaaaacagttgaaacacttaagcaacaggctatattcatccctaaaaaggtgaaggatgtatatttgatgcatattttggctaaaatggaagatatgggaattcggtctgccattgtatttatctcaacatgcagagattgtcatcgtttaagtttaatgctggaagtgcttgatcaagaagcagcagctctgtattcattcaaatcacaagctcagaggcttgaagcacttcaccaatttaaatcaggaaaggtttcaatactgctagcaactgatgttgctagccgcggtttggatattcctacagttgatcttgtcatcaattatgatgttccaaggtttccacgagattatattcatcgtgtaggtcgtacagcaagagcaggtagagggggactggctttgagtcttgtcacccagaatgatgttgatcttattcatgaaatagaagcacttattgagaagcaacttgaaatgattgaatacaaagaaaatgaggtgctttctctcatgaaaaaggttttcagtgctaagaacgtagcagaaatgaagatgatagatgatggctttgaagagaaagctaaagagcggaaaaaacagaagctgaaaatgctagcagataaaggattgttaaataaaagaagtaaaaagagaaaacgaaataaagaatttgcagaggaaggggaagaacaaaaaaatgaggttttcactgttaggaatgtgacggaaatgaagaggatggatgaggatggcattgaggagaaagcagaagaggggggaatacaaaaacttaaaatgcgaacacagaaaggtttgtcaaagaaaaaaaagttaaaagaaagaaataacgaatttgcagatgaagggaaaaaacagaaaaaagagaaagtagaagcattagcagatatagaaactccaaagaaaaggagtaagaagagacagtaa

SEQ ID NO: 3091 - DNA, 591 bp, Glycine Max
atggagcatttgggccaaatagaagagcgtattagatgcctagaagcagtagttttcagggctaggcagcgtcagaggcagcgaccgagtcatgctccaattcaggtaactaactatgcaggagaattgggaacagtagctgatctaccagccgaagaagaaaggttgcatcaagagtttggtggtattgatgttggaggagagatggtgggagatgggagaacgtgtaaaaggaaggctagctatttggttgctaaagcattgggtgtggaaaccagtcagggtgagggttttgcaacaaatttgtttcattgtaatgtatgcttggacagggcaagagatccggttttgacctgttgtggtcacttgttttgctggccatgctttcataagttgtcgtatgcttattcagatgtcagggaatgtccggtttgtaaaggagatgtccctgaagaaggaattgtcccaatatatggcaatgtaagtgttgataacagtggcaagtttgacttgaatgaaactgattcgacagttcctgctcgacctcgtccacatagaattgagagtattaggcagcggttcagatattga

SEQ ID NO: 3092 - DNA, 1896 bp, Glycine Max
atggagcgaatgatttcatctttcatgtctttgttttttattctttggatattcgtggtgcttgacttagttctcaaggtttatggccacgcagaaggtgatgccctgattgtattgaagaacagtatgattgatcctaacaatgctcttcataattgggatgcttcccttgtcagtccttgcacatggtttcatgttacttgtagtgaaaatagcgtaattcgtgttgagcttggaaatgcaaacctttcgggtaaacttgttccagagcttggtcagctcccaaatttgcaatacttggaactttatagtaataatataactggggaaatcccagtcgagcttggaaatttgacaaacttggtgagcttggatctttacatgaacaaaattactggtcccattccagacgaattggccaaccttaaccaactacagtccctgcgtctcaacgataacagtttgttgggaaacattcctgtgggtttgaccactattaattcacttcaagtgcttgatttatcaaacaacaacttaacaggagacgtcccagtcaatggttccttttcaatttttactcccatcaggcaaggagaaatgaaggcattgataatggataggttgcatggttttttcccaaatgtttattgtaacaacatgggttattgtaacaacgtggataggcttgtaaggttgagtcaggctcataacctacgtaatggtatcaaagccattggagtcattgctggaggagttgctgtgggtgctgcactgttgtttgcatccccagtaattgcacttgtttattggaatagaaggaagccactggatgattactttgatgtcgcagctgaggaggatcctgaagttagccttggtcagcttaaaaagttttcactgcctgaactgcgaattgcaacagataactttagtaacaaaaacattcttggtaaaggtggatttggcaaggtttataaaggacgtttaaccaatggtgatgatgtagcagtaaaaagacttaaccctgaaagcattcggggagacgataagcaatttcaaatagaagtggacatgatcagcatggctgtacatcgaaatttacttcgcctgattggtttctgtatgacatcttctgaacgcttgcttgtgtatcctttaatggctaatggaagtgtagaatcacgtttacgagagccttcggaatcacagccaccacttgattggccaaaacggaagaatattgctctaggagctgctagggggcttgcttatttgcatgatcattgtgacccaaagattattcatcgtgatgtcaaagctgctaatatattgttggatgaggagtttgaagctgttgtaggagattttggtttagcaaggattatggattacaaaaatactcatgttactaccgctatatgtggtacgcagggccatatagcaccagagtatatgacaactggaaggtcttcagagaagactgatgtttttggatatggtatgatgcttcttgaactaataactggacagagggcttttgatttagcacgattggccagggatgaggatgccatgttgcttgaatgggtgaaagtacttgtgaaagacaagaagttggagacactgttggatccaaatttgcttggaaatcgttatatagaggaagtagaggagttaatccaagtggccttaatatgcacacaaaaatctccttatgagagaccaaagatgtctgaggtggtgagaatgctggagggtgaaggtttggaagaaaagtgggatgaatggttgaatatgacagaggatatacaaaatttcaccttcaacctctgcactcctactcctaatgactcaaatccaaatattcaaccagatgttctgtcaggtcctagatga

SEQ ID NO: 3093 - DNA, 462 bp, Glycine Max
atggagcggagcgatgacgaatctgacggagatggcctccaatctcgactctctccagaagcttctcctcaccaaagccgtcttcgtcgacgacgacaccttctccaaagcctccctcgccgccgaccaagcccgctccatcaagctcctccaccaacgagtccaaaccttggagagagaggtcgacgctgccatcaccgccgccgcccgcgctcgctccgagaagcgccaggccgaggccgctcagaaatccgccgaatcgcgcgctcaacaactcaccgccgaactcgaaaacaccacaagtatcatcatcatcatcatcatttagaggtgtttgagttgcacatggaagagctgcgtgcgaagcaagaagagatcgagaagcgtgacgaggacattaaacttctggaagctataattcgaacgcttggaggaaaggaatcgctctctacgtctcagtag

SEQ ID NO: 3094 - DNA, 1509 bp, Glycine Max
atggagcttcttattcccttctctctcctattcacctttgcttgcattctccttgcattgttcaacactctgaaccgttcaaattccaaaatcttaccacctggaccatggaaactgcctcttcttggcaacattcaccaatttttcgggccacttccccaccaaactttgacaaacttggctaaccaacatggaccgttgatgcacctacaacttggtgaaaagccacacattatagtctcttcagcagatattgccaaagagattatgaaaactcatgatgccatctttgccaataggcctcatcttcttgcttccaaatcctttgcctatgacagcagcgacatagccttctcttcttatggaaaagcttggaggcaactaaaaaaaatatgcatttcagagttgctaaatgctaaacatgttcaatcactaaggcacataagagaagaagaggtatctaagctagttagccatgtatatgcaaatgaagggtcaattatcaatcttactaaggaaattgagtcagtgacaatagctataattgcaagggcagctaatggtaaaatatgcaaagaccaagaagctttcatgtcaacgatggagcaaatgctagtgctgttgggaggtttctcaattgctgatttctacccttcaatcaaagtgcttccattgctcacaggaatgaaaagtaaacttgaaagggcgcagagagagaatgacaagatcctagaaaatatggtcaaggatcacaaggaaaatgagaacaagaatggggtgacgcacgaggattttattgatattcttctcaaaactcaaaagagagatgacttggaaattcccttgactcacaacaacgtcaaagcactcatctgggacatgtttgttggtgggacagcagcaccagcagcagttacagtatgggcaatgtcagaactcataaaaaatccgaaggctatggaaaaggcacagactgaggtaagaaaggtcttcaatgtgaaaggttatgtggatgaaacagagcttggacagtgccaatatttaaattcaatcataaaagaaacaatgaggctacacccccccgaagcattattactcccaagagaaaacagtgaggcatgtgtagtcaatggatataaaatccctgcaaagagcaaagtcattatcaatgcttgggccattgggagagaatcaaagtattggaatgaagcagagagatttgtgccagagaggtttgtagatgactcttatgacttcagtggcacaaactttgaatacatcccttttggggccggaaggagaatttgtcctggtgctgcattttccatgccttacatgttgctgtcactggccaatttgctttaccattttgattggaagctgccaaatggagcaacaatccaagaattggatatgtctgagtcttttggcctcactgttaaaagagtacatgatctttgcttaatccccattccttatcacccaacatccaaactgggccatctataa

SEQ ID NO: 3095 - DNA, 1800 bp, Glycine Max
atggaggaaaagcacgcagcagccatcgaatccgcacacgccgaatctaacggcgtctctcacggcgccgaccacggctggcagaaggtgacctacgctaagaaacagaagaagaagactgttaacgccgctaacggcggccccgattcccgcgccaattccagcaagctcgttccgaacggcacgctgtccggcaacgacggcgtgttccggtcgctcgaactgcaatcggaggaccggcgccgaaaaattgtggaggcgaagaagctggctgatgccgcgtacgacgacgaagacgcgccgctcagatcgaagcagcggcatcgcgacgacgacgacgaatacgactacgatgacgagaatgtggaccgttccgcggagaacgggaaggccgaggaggcgaagaaggtgaagccgaagaaaccgaagaagcctaaggtgacggtcgcggaggccgcggcgaagatcgacgccgctgatctgggcgctttcctcatcgagatatcaggatcgttcgagaaacagcaggatatattgatgatgcgattcgctgattattttggacgtgccttttctgctgtgaccgcatctcagtttccctgggtgaaattgttcagggagtcaagcgtggctaagatcaccgatacgccactttctcacatatctgatgctgtatataaaacatcaatcgactggattaaccaccgttctcctgaggcacttagtacctttctgatttggtctttagatagcattcttgctgacttgggtagccagcaaaatgtggccaagggttccaaaaaggctgtgcaacaagtgtcctcaaaatctcaggttgcaatgttcgttgttttagcaatggtattgcgtcggaagcctgatgctcttatatctgtattgcccacattgagggagagtacaaagtatcaagggcaagataagcttccagtgattgtatggatgatagctcaggctgctgtaggagatctctcagtaggtttgtatgcttgggcacggaatctcctacccatagtgattggcaaaggtggtaacccccaatccagggatttggttttgcagctagtggaaaaaattttgtctacccccaaagcacgacctgttttagtaaacagtgctgtgagaaaaggagaacgattaattcctccttctgcgtttgaaattttggtccgggttactttccctccatcttcaactagagtaaaggctactgaaagatttgaggccatatatcccactctgaaagaggtggctcttggaggttctgctggaagtaaatcaatgaaacaagttgcactgcagatattcagttttgctatcaaagcagctggagaaaataatcctgagttatcaaaagaagcagctggtatttttatttggtgtttgagtcaaaacactgaatgctacaagcaatgggaaaatgtttatcaggacaacattgaagcaagtgcttcagttctgaagaagctttctgatgattggaaggagctatcaacaaaattgtctcctcatgatcatctgagggataccataaagaacttcaagcaaaagaatgagaaagtattggactctgagactgatgctgctcgtcatgcacacttcaaggatgccgataaatattgtaagataatcttaggaagagtttcgcgaagtcatgggtgcacgacttgtttaacctttacagttcttgctttggctgtgggtgctgctgtttccttgtcccccaatttggaatctttggattttaagaagctctcggaacttttcatcgttcggcactga

SEQ ID NO: 3096 - DNA, 1644 bp, Glycine Max
atggaggaaaagcacgcagcagccatcgaatccgcacacgccgaatctaacggcgtctctcacggcgccgaccacggctggcagaaggtgacctacgctaagaaacagaagaagaagactgttaacgccgctaacggcggccccgattcccgcgccaattccagcaagctcgttccgaacggcacgctgtccggcaacgacggcgtgttccggtcgctcgaactgcaatcggaggaccggcgccgaaaaattgtggaggcgaagaagctggctgatgccgcgtacgacgacgaagacgcgccgctcagatcgaagcagcggcatcgcgacgacgacgacgaatacgactacgatgacgagaatgtggaccgttccgcggagaacgggaaggccgaggaggcgaagaaggtgaagccgaagaaaccgaagaagcctaaggtgacggtcgcggaggccgcggcgaagatcgacgccgctgatctgggcgctttcctcatcgagatatcaggatcgttcgagaaacagcaggatatattgatgatgcgattcgctgattattttggacgtgccttttctgctgtgaccgcatctcagtttccctgggtgaaattgttcagggagtcaagcgtggctaagatcaccgatacgccactttctcacatatctgatgctgtatataaaacatcaatcgactggattaaccaccgttctcctgaggcacttagtacctttctgatttggtctttagatagcattcttgctgacttgggtagccagcaaaatgtggccaagggttccaaaaaggctgtgcaacaagtgtcctcaaaatctcaggttgcaatgttcgttgttttagcaatggtattgcgtcggaagcctgatgctcttatatctgtattgcccacattgagggagagtacaaagtatcaagggcaagataagcttccagtgattgtatggatgatagctcaggctgctgtaggagatctctcagtaggtttgtatgcttgggcacggaatctcctacccatagtgattggcaaaggtggtaacccccaatccagggatttggttttgcagctagtggaaaaaattttgtctacccccaaagcacgacctgttttagtaaacagtgctgtgagaaaaggagaacgattaattcctccttctgcgtttgaaattttggtccgggttactttccctccatcttcaactagagtaaaggctactgaaagatttgaggccatatatcccactctgaaagaggtggctcttggaggttctgctggaagtaaatcaatgaaacaagttgcactgcagatattcagttttgctatcaaagcagctggagaaaataatcctgagttatcaaaagaagcagctggtatttttatttggtgtttgagtcaaaacactgaatgctacaagcaatgggaaaatgtttatcaggacaacattgaagcaagtgcttcagttctgaagaagctttctgatgattggaaggagctatcaacaaaattgtctcctcatgatcatctgagggataccataaagaacttcaagcaaaaggtagttttacaggcaaaagagctagactttgagtttattgcatctgggattgctctccaatctccccctggttga

SEQ ID NO: 3097 - DNA, 1413 bp, Glycine Max; identical to SEQ ID NO: 329

SEQ ID NO: 3098 - DNA, 2331 bp, Glycine Max; identical to SEQ ID NO: 330

SEQ ID NO: 3099 - DNA, 2331 bp, Glycine Max; identical to SEQ ID NO: 330

SEQ ID NO: 3100 - DNA, 711 bp, Glycine Max
atggaggactatcacgtagcaaaatttgtccagttcgaagggcgagagcttgggctttttgctatatatgatggacacctgggtgacagtgtaccagcctatttacaaaagcatctgttttctaacatcttgaaggacgaggacttctggaatgatccattcatgtccatttctaatgcatatgagacaacagatcaggcaattctttctcacagtcctgatttggggcgaggaggatcaactgcagtaactgcaattctcataaataatcagaaattatgggtagccaatgttggagattcacgagctgttgtttcaaggggaggggtggctggacagatgtcaactgatcatgaacccaatactgagcggggcagcattgagaccagaggtggctttgtctcaaacatgccaggagatgttgcaagagtgaatgggcagctagcagtttctcgagctttcggagacaaaaacctcaaaacgcacttgcgatctgatcctgacattcagtatactgacattaccccagatgttgagcttttgatacttgctagtgatggtctatggaaggtaatggcaaaccaagaagctgttgatgttgcaagaaggataaaggatccacaaaaggcagcgaaacaactagccactgaggcattgaacagagacagtaaggatgatatttcctgcattgtagttcgtttcaagggttga

SEQ ID NO: 3101 - DNA, 1011 bp, Glycine Max; identical to SEQ ID NO: 332

SEQ ID NO: 3102 - DNA, 1395 bp, Glycine Max
atggaggaggaggatgagattcttcaagcacgggcgtgtaagttgccaagaagaagaggcagtgatggggagagcacgaacagcaggttccacagcagcagctggcaccaccacaactcttcgaggatcataagggtgtctcgagcatctggtggcaaagacaggcacagcaaggttatgacttcaaaagggttgagagatagaagggttaggctttctgtgaacactgccattcagttctatgaccttcaagatcgcttgggttatgaccaacctagtaaagctgtggagtggcttatcaaatctgcttctgatgccatttctgaacttccttctttgaacaatttccctgacactccccaaagtgatgatcatgagaagagggaaaacaccgctgatgttgctgttggggtagtagatggtgagaatggcaatggccagaacttgagtttggctaaatctgcttgtagtagcaattctgagactagcaaaggttctggcttgtccctctcaaggtctgatattcgtgtgaaggctagagagagggcaagggagagaacaacaaaggaaaaggagaaagagaaagagaaaaatgatgagtctcatcgtcatcatcacaatgttgttgttgttcctcatcacaaccacaatgtgaacctcgtttcacaaacagcttctttcacggagctactcactggcagtgatcccaacaaagggtgtgatgaggctaataacaacatgatgttcaacaaagcagcaggtagactgcaatggtgttcatcaacaacacctatggactactttctggggctttcctcttctagaacaacgacacacaatcacaatcaccttcatcatcatcaatattcttcttcttcttctagtgggttctcattggcacaaatccaactaggacattctcttcctgaggcaatgaatcatgtttcagcattcaacaacaatgtgagtggtgataaccacaaccactcatcatcagatcctcatctgcagcagcaacacttgtcattgataccggatcatcttatgtcagctgtggttacttcttctgctgcttcttctcatcatcatcatcatcatcagcccagcgggaacgattacaatctgaactccaccatgtcttcgggcctcgctggttacaatagggggacccttcagtccaattctccgtctctgctgcctcactcgcagaggttttcgcctatagacggatccactgtacctttcttcattggagctgcttcttctgctgctgcagttgctgctcctgccatggagaacaacaacaacaacaaccatcaccagcatcagttctcttctgtttttgatggcagccgcttgcaactttactatggccattctgaccagaaggggaaa

SEQ ID NO: 3103 - DNA, 1140 bp, Glycine Max
atggaggagggaaaattgagagagctgaagcaattcatagagatatgcaagtccaatccctcacttctccacaatccatctctttcattcttcaagacttatcttctcagcctcggtgctcgcatccctccccaacccaaaacggaaccaggtgattttgatgacaagtcagatcctcctttatccgcacaaaatgacattgtagaatctgatatagagttggataatgctgatgttgttgaacctgataatgaccctcctcaaaagatgggagatccttctgctgaaataacggaagaacaaagggatgctgcacaactagcaaaatcaaaagcagtcgatgctatgtcacaaggtaatttggatgaagcactggcccaactgacagaagccattttgttgaatccgcaatcagctatactttatgctactagagctagcatctatatgaaattgaagaaaccaaatgctgctatacgtgatgctgacactgccttgaagattaacccagactcagctaaaggctacaaaatacgaggaatgtcaagggctatgttgggactatgggaagaagcagcaagtgaccttcacgtggcttcaaagttagattacgatgaagagattagtatggcacttaaaaaggttgaacctaatgcccttaaaatcgaggagcataggagaaaatatgaacgcttaagaaagcaaaagcaacagaaaagagctcctatcaagactgaagctcctattaagaaggagcaagaaactgaagcccaagtacaagcagcattatctgctttaaaagatgggcaagtcatgggtattcactctagtggtgaattggaaaagaagttaagtgctgcatcaaagacatcacgcttggcgatcctgtattttactgcaacatggtgtggcccttgtcgcttcatttcccctatttatacaagcttggctgaaaagtacccaaaagtggtttttttgaaagttgacatagatgaggccagggacgttgctgcaggttggaatattagcagtgttccgacatttttctttgttaagaatggcaaagaggttgacagtgtggtcggggcagacaaaagtacacttgaaagcaagattgcacaacatgctggctctctttaa

SEQ ID NO: 3104 - DNA, 975 bp, Glycine Max
atggaggagggaaaattgagagagctgaagcaattcatagagatatgcaagtccaatccctcacttctccacaatccatctctttcattcttcaagacttatcttctcagcctcggtgctcgcatccctccccaacccaaaacggaaccaggtgattttgatgacaagtcagatcctcctttatccgcacaaaatgacattgtagaatctgatatagagttggataatgctgatgttgttgaacctgataatgaccctcctcaaaagatgggagatccttctgctgaaataacggaagaacaaagggatgctgcacaactagcaaaatcaaaagcagtcgatgctatgtcacaaggtaatttggatgaagcactggcccaactgacagaagccattttgttgaatccgcaatcagctatactttatgctactagagctagcatctatatgaaattgaagaaaccaaatgctgctatacgtgatgctgacactgccttgaagattaacccagactcagctaaaggctacaaaatacgaggaatgtcaagggctatgttgggactatgggaagaagcagcaagtgaccttcacgtggcttcaaagttagattacgatgaagagattagtatggcacttaaaaaggttgaacctaatgcccttaaaatcgaggagcataggagaaaatatgaacgcttaagaaagcaaaagcaacagaaaagagctcctatcaagactgaagctcctattaagaaggagcaagaaactgaagcccaagttttatttttacatcactattggtataatggaattggatggcatttcattccttctggagattccacctgttctttgacaattatcacacgtctggacatattcataagcacccttccacaatgtaggccaatagaaactagactgcttgagttcaatcattcaggatgcttgttttatgaggatgatactttctcgtaa

SEQ ID NO: 3105 - DNA, 276 bp, Glycine Max
atggaggcatccattatgttacctcttgaaaggacttcgtcaattgaaagagagcccaggactcttaatatcaaccaaattcaatccgctagggagttagcaatatatatattgaacacaaagaccatagaagaagcgtccagaattttcacggaggggttgcagccggtggttagtgctgctccaaagatgggtttgggtgaagaagttgaagtgttggactccaaagtagcctccgtagcagcattcagggacatagcatctgcacctttctag

SEQ ID NO: 3106 - DNA, 954 bp, Glycine Max
atggaggcgattctgaagcggaagctgtcggggaatcacgaggacaccgacgacgagctcatggaggagctccgcatgcgtcccctcgacgacgtcgacgaccgggactttgagtccgacttcgagtccattcacgacaccgacgaggagatcgacgatttgtacaacgccagggacgtggtgatgaagaggatggtgaaggatgagtacttcaacatggatgataaaaagtgggatgacattgttgaggacgggatcaagcacgggcttcttagggacaccaaggagtgcgaggagattctcgaggatatgctcagctgggacaaactcctccctgatgatataaaacagaaggtggaagtaaaatttaatgagctaggggacatgtgtgaaagaggtgaacttgaacctgaagaagcttacgaacagtttaagaagtttgaggatgagattgtggcgaaatacttggacaaaatggaaaaagaggaggcctcacagtttgatgatactgttgtgccagataagaaaaaggacttggatgatccaccgggtgaaggtccaattctgcggtggcaaactcgggtagtctttgctcctggtggtgatgcttggcatccaaaaaacaggaaagtgaaactgtcagttaccgtgaaggagctagggctttcaaaataccaatttcgccgtctcagagaattggtaggaaaacgttatcatccagggagagatgagcttacaataactagtgagaggtttgaacatcgagaagaaaacagaaaggactgcttaaggacccttctctctctcattgaggaggcagggaaagctaataaactagtggatgatgctcgatcttcatacgtaaaagagaggcttcataccaatccagctttcatggagaggctgcatgcgaagtcaatgaggttgcgagaatctaatcaggttcctgcttga

SEQ ID NO: 3107 - DNA, 1209 bp, Glycine Max
atggagggaattcctgtgaggactgtgataccttcagctacaagaagggttcccacccaaaacagaaatttacgctttgctgttcgagccaaactctctccttctgattttcaagattttcagagctatgctaggccttcacatctcttgccagcctctgaagtgaaagtgtatacaaatacatcagtagaaaacatttcgtcatctttgaaggaggatggatccaaatctttatttagggtcaagttagttacaagcaacgcttatggctcagctattagtgacttaagtgctggacttctactatgcttgatagatgaaaacggaaattctatattgcaaaggatccctgtgagtttgatgatgggtcgttctacagaatcaggggatatgactaatattgacatgcttcatttccaaagaggttctttagatgaattcatttttgagggtcctaaaattgcacgacttgaggctctttgggtcagtgttgaatcaggtcagtggcgcctaggaagtgtatccttaatggttattagctgtgaagggaaaccatcaggactggaagatggggtaacaagttacactggcttccagtatgactttcagattgatgatgtgttgcttggtgagggaactgatctgtccatgttggaattaagacctagccttgtgactgagctggaagggattgatcccataagcatcttcaacaaaggacttaatgaccctaccttgttctcaagtcctaagatctcaaatgaagagagcatgaaggaatatgcagatttgaagttctcattgttattttatgatgctatgttgacactattcggtacatcagttgcttccctctcagctggggaaaatgctgggattgctttcttgattggtgggattggaggcttcttgtatctgctactattgcagagatctgtggatgaattgccagcttcagaattaatcaccaatgacaagggaagaactgatgcactgttcagaggagtgaagggtccaatagcaagtgtggcattggctataggcttggctgtaattgcatcaagatatagctctggagatcttgaactgatgctaacaccaaaagatctcatagttggaatgatgggatttcttgcatgtaaagtttctgtggtgttagctgcatttaagcctattacactaggtccaaagttaccaagtgatatgtaa

SEQ ID NO: 3108 - DNA, 1074 bp, Glycine Max
atggagggaggtgtccctgaagctgatggctctgctttcaaagagtgcatttctctttcaaagaacaacccttatgttcttcgccttgctttttctgctggaattggaggccttctctttgactatgacactggtgtgatatctgggtctcttttgtatatcagagaagatttcaaagatgtggacagaaagacttggcttcagtttttttttttaattttagtcattttcccaactctttggttgcttcttgaacgtgtaacagggaaagcaagaagaaggtatacaaattttattcaaaatttgagggaatcaactgaaatggaaatcaaggaagtagaagctggaggtaaggtgagcctggtaaaaatgctcaaaatcacaagtgtgaggagaggtttatatgctgggatgggcatagccattttccaacagtttgtgggcatcaacacagtcatgtactacagccccaccatagctcagttatctggttttgcctccaatcaggtagcaatgcttctgtcactcatcacagcaggggtaaatgcatttggttccattctgagcatatacttatttggttggagttttggcatcccttgttcttcttactgtcgtttttcgccattccgagatttcctcttcactgcagctaccaaccacgatcaatgggatttcatgacttgccttaaaggttctaaaaaatgtggcttctgtgctgcctcagataagctaaaacctggggcatgttgggactatgacaaatcggagaatcattgtacttcacaacacagggattggtactccaaagggtgtcctagtaaaactggatttgttgcaatgataggcctagcactctacatcttgttcttctcacctggaatgagaactgttccatataggactattgggactgcatacacattcatggtttttggaataattagtttagaagacattatctttgtacttgatttcgtgccagaaaccaatggagttcgaatggaggatatagaaagggttctggaagagagatctctccacttgaagttttggcagaaatctacctcgtga

SEQ ID NO: 3109 - DNA, 1026 bp, Glycine Max
atggaggggtctcacatggggttgttgctcttcttttgttcttccatgctttttgctgccttcgctgctgcctcctccagaaacttgcccataataccctttgatgaaggctacgcgcccttgtttggggacagcaacttggtcatccatagggatggcaaatcggttcatctttcactcgatgagagaacaggttcaggatttgtgtcgcatgatctttaccttcacggatatttcagcgcttctattaagttgccttctgactacactgcaggagttgtggttgccttctatatgtcaaatggtgacatgttccagaataaccatgatgaaatcgactttgagtttttggggaacattagaggcaaagactggaggattcagaccaatgtttatggcaatggtagcaccaacattggcagagaggaaagatatggtctgtggtttgaccctgcagatgatttccatcagtacactattgtctggacagactctcagatcatattttatgtggacaatgttcctattagagaagtgactcgaacagaatctatgggaggggatttcccttctaagccaatgactttgtatgcaacaatatgggatgcatctgattgggctaccaatgggggcaaatacagggttaactacaagtatgcaccctatgttgctgaattctctgaccttgttctgcacggttgtgcagtggatccaattgagcagcacgtggccaagtgtgacaatgctcctcaaagttctgaggcaactacaacaattccttcttctggtgttacaccagcacaaagaatcaaaatggagaatttcaggaagaagcacatgacatactcctactgctatgacaaagtcagatacaaagtccctccttcggagtgtgtcatcagttcccaagaagctgagaggctgaggaggttcgatcccgtcacatttggaagcggccgccgtcaccatggaaaacgacaccgtcgcagcagaggaagccagacagaagccgctgcttcattttaa

SEQ ID NO: 3110 - DNA, 1446 bp, Glycine Max; identical to SEQ ID NO: 333

SEQ ID NO: 3111 - DNA, 1446 bp, Glycine Max; identical to SEQ ID NO: 334

SEQ ID NO: 3112 - DNA, 1461 bp, Glycine Max; identical to SEQ ID NO: 335

SEQ ID NO: 3113 - DNA, 591 bp, Glycine Max
atggaggttcaatctcctgcagcaaaacgtcactatgacatcaccatgtcaagaagaacaaggaaacaacaacaacaacaacaacaacaatttccagtgcaaggcaatgagaaaaccaaatcagaaatggatgatgaagcaacaacaccaaaggatgttcatgttcatgtcacagtggaaacaaaatcttctcaaactaatgtttctattgctgatgaggtgaaagagggtggtggtgagagtgaccacaaaagcttgaagcaactcatcataggagatgatgatcacaaagaagcaaagaaaaagggtaacaataataacaataataatgataataatagtgatgatcatgagagaggtggcaaaggaggatcaaggaactcacttggtgaacatttcactgaggaagagaagcagcataatcttcagctggttaggatgcaacagaataaagacaacctccaaggcttgaagttcaagaagttggtgcgtcgctacgccaaagttttggggcatttgatgaaggctaagcgtgatcctcatctaggaggtgatgctgggaaaaaacctgttttcaagttatcaacttag

SEQ ID NO: 3114 - DNA, 1548 bp, Glycine Max
atggagtacgagaggatagagaaagttcaggctggaataatttcccccagtaaactgaggatgaagttattaggacctctccatcataggaagaaagatggatccaacagtaactcatccagaacttccccttcaaggattgaggatgctgaatttgtgaatagcttacttggctcaaaaaatgacaaccttgatgatgaagttacatctccaagcttggatgttctacaaaatggccagatttcctatgaaccaaaggagacaatgcctaaggaaaacagcgacacggggcgtgtaaagatgcagcattttcagaaggttgacacgggaagttcaagcgcaattcatgcggtgagagcaatagaagatgaaaatcttgattatgacagcaatgctagctcgtccagttttgagtttgataaaggggagagaccagggaacaatcctgccactagatccctattcagacctattccttctaagtggaacgacgccgagaaatggataatgaataggcaaaacatacaggctaatcactcgaaaaagaatactgcacataaccaagcaaatcgcatgccaacaaatatgggcagggttgcaccagagtctggtaattatgatcataaactcccaataggcaaggccacagaaacaaagcgagtcgatatctgtcagcctacgtcacatatgggatttgagaaattctcttttgttccctccgatgctcattcggtttcaggtcaagcacacggaagaaatccagttgtggagtctcttccccaaagcaaagatctaaaggatgtcaatgaattggtgatgcctgggataagatctgttgccatgagagacatgggaactgaaatgacccctgtgccaagtcaagaaccttcgcggactgctactcctgttgggtctgcgacaccactacggagccctgtttcctcaatgccgtcgactcctaggagaggtgcacctgctccgacacctttggacaacacgaccaatgaggattcccagtttccagttgaaaatggcaaaaggcatttgtctgaagaagaaatgaagatcaagacaaggagagagattgcagcccttggggtgcagcttggtaagatgaatattgctgcatgggcaagcaaagatgagcaggaaaagaacaaatcttctccccgggacatgagtgtgcaagaacaggagagaattgaatttgaaaaacgtgcagctctgtgggaggaagctgagaaatctaaacatactgcaagatttaagcgagaggaaatcaaaattcaagcatgggaaagtcagcaaaaggcaaaattagaagcagaaatgagaagaattgaggccaaagttgagcaaatgagagcccagacacatgcaaaaatggtaaaaaagattgctatggcgaggcaaagatcggaagaaaaacgtgcagcagctgaagctagaaaaaatcgagaagcagaaagaactgtggctcaaacagaatacattcgccaaacaggacgattgccctcttccaattacatttgttgtggttggctgtga

SEQ ID NO: 3115 - DNA, 2166 bp, Glycine Max
atggagtacggtagcggaggcggtgggtcacagtccccaggggagcaagatggctcagattcccaagagaggaggaagcgctatcatcgtcatactgccaatcagattcagaggcttgagtcaatgttcaaagagtgcccccatccggatgagaaacaaaggttgcaattaagcagggagttaggcctggccccgaggcagatcaagttctggttccaaaataggaggacccaaatgaaggcccaacacgaaagagctgacaattgtgctcttcgagctgacaatgacaagatacgttgcgagaacatagccatcagggaggccttgaagaatgttatctgcccttcttgtggtgccccacctctcaatgacgattgttattttgatgaccaaaagttgcgattagagaacgcccacctcaaagaagagcttgatagagtatctagcattgctgccaagtacattggaagaccaatttcccaactcccgccggtccagcctattcatatatcgtctctggacttatcaatggcgagttatggaaaccaagggatggttggtcctgctccttcttcccttaatcttgatcttcttcctgctgcagggacttcctcatcatccatgccttatcatcccccttgcctttcggacatggacaagtccctcatgtcagacattgcttccaatgccatggaagaatttctaaggctcgtgcagacaaacgaacccttgtggcttaaatcaaacgtcgatgctagagatgttcttagttgtgatgcctacgaaagaatgttccacaagcccaatactcgccccaagaatcctaacgttcgcattgaagcatcccgagattctggagttgtattaatgaatactttagctttggttgatatgtttatggacccaaacaagtggatacaactttttcccactattgtctctgtggcaaggactattcaagtcatatcttctgggatgatgggcagttgcagtggttctttacaattgatgtatcaagagttgcaagtgctttctccacttgtttcaactcgggagttttacttcctgcgttactgtcagcaaattgagcagggaacatgggcagtaatggacgtttcttatgattttccccaagatagccactatgctcctcaatttcggtctcatcgttgtccttctggttgcttgatccaggacatgcctgatgggcattccaagattacttgggttgaacacgtagagattgaagataagactcttcctcaccggctttatagaaatcttatttatagtgggatggcatttggagctgaaagatggcttactaccctccagaggatgtgtgaaagacttacttatctgatggctacaagcaatcctacccgggataatctaggaggagtaatttcatctcctgagggcaagaggagcatgatgaaacttgctcaaaggatggtcaccaatttttgtgccaacattagcacatcaagtggccatcgatggaccacgctctctggattgaatgaaatcgtagtaagagtcactgtccacaaaagctcagatcctggacaacctaatggtgtggtgctaagtgcagccactactatttggctccccacccctcctcacgctgtctttaatttcttcaaggatgaaaacaaaagacctcagtgggatgttctttccaacggtaatgccgttcaagaggttgccaacatagcaaatggtttgcaccctggtaacagtatatcagttcttcgagctttcaacaacagtactcagaacatgttaatactacaagaaagctgcatagattcctatggttcatttgtggtttattgcccagttgatctgccatccatcaacttagcaatgagtggtgaagacccttcatacattcccctactaccaaatggatttaccattttgcctgatggtcagcctgaccaggaaggagatgatggagcatcaaccagctctaacaacgcaaacaggaatatagtaaggtctggtggttcactagttacaattgcattccaaattcttgtgagcagcttgccatctgctaaactcaatatggagtcggtgacaactgttaacaatcttattggctccactgtccagcaaataaagtcttccttaagttgtcctaccctacctagctag

SEQ ID NO: 3116 - DNA, 369 bp, Glycine Max; identical to SEQ ID NO: 336

SEQ ID NO: 3117 - DNA, 2598 bp, Glycine Max
atggagtccgattccgactccgatggatctcacatctccgcaactccaccaagaaaatcaactccatcaccaccaccaccaccacctgtagtagtttcaaaaaaatccagaatcagaatcaaaccttcaaaatcaaaaccaaaaccagacccttccggatcctccaaaacccagtccaaatccgacccgatccagcaagccacccttctctccctccccaccgatctacccttccaaatccggcgaccttccgacgcgccgtcgatttcacctctcctcaatctagaaccttctgaagtcgaacaaccggtttttacttccggcgcgtctgactcacgcgccgagggcgccgacttgaggaagcgtgggaagagccagcttcccaacctgattggctccagtgcgccaatgccgagcgtgaagccgcgaacatccggagccggcgaagggaacttcgtgaagctcaacatgaatggcaagagaaagaagttccttaacaagagagggaaatttggcgggaaaaggagggagattgatggtgatgcagtggaggaggctgcgaccgcagcacgcaaggagccttcggaggagaatttggtgaagctgttgagattggttcatggttatgattgctttcgagatgggcaggttgaggcgattaaaatggttcttgccgggaagtctagtgtggttgttttgccgaccggtgcaggaaagtcgctgtgttatcagttgcctgctgtgatcttgcctggtgttacattggttgttagtccattggtagctttgatgattgatcagttaaggcaattgcctcatgtgattatgggtggtcttctatccagcactcagacacctgaagaagcctctgaatcactcaagcagcttcgtcaaggggggataaaggtgctttttgtttcaccagagcggtttctgaatgaggagtttctgtctactatttcttctttgccagccatctcacttgttgttattgatgaagcacattgtatatctgaatggtctcacaatttccgaccatcttttatgagacttagagcatctctgcttcataagacacttaatgttcgttctgtgcttgctatgacagcaactgctacaaccacaactttagatgccatcatgtctgctctagacattccttccacaaatcttattcagaaggcgcagttaagggacaattttcatttatcagtgtctttggtcagaaataggcaaaatgaaagacctactgaatctgataaagtctcctccttttgtggaagttcaaagcatgatcatatactgcaaatttcagagcatttgatatgtataatattgttggcagaaaaaaaaaagttatatgaaactgatcaaattaacagatatttgaatgataacaacatcttggcaaagagttatcatagtggtatctctgcaaaggaacgtagctatgtacaggagttgtttaattccaacaagatcagagtggttgttgcaactgtggcatttggcatgggactagataaaagagatgtcggagctgtaattcattacagtttgcctgaaagtctggaagagtatgtacaggaaataggacgtgctggaagggatgggaggttgtcgtactgtcacctattttatgatgatgagacatatttcaaacttcgtagtctaacgcacagtgaaggagtagatgaatatgcagtgaacaaatttctgcgtgaagtgtttcctgctgacaaaaactcctgtgggaaaatctgttcattaatcaaagaatctgcttcacgcagatttgatatgaaagaagaggtgatgcttacacttttgacacgcttggagttgggtgatgtacagtacttgcagttacatccacagataaatgtaactggcactttgaattttcacaagtctcctccgccattacttgctcagaaggtttctgctatagctgtaattctaaaaagatctgaaaccaagcatgggcaatatatttttgacattccaactgtggcaaatgatatgggggttacagcagtggaattaataaatcagttgtacgacctgaagttgatgggagaaataacttatgaaatgaaggacttggcctactgttataggatcattgaagtcccaacagacttgttatctctatcagcagatattacccgatggttatcagaagttgaaaattgtaaggtacgaaaaatggatgcaatgtttaatgctgcatattttgcattaaatctatgtgatacgatgcaaggttgcagtggtgccaatcatacaccatgcttgcaaaggaaaatattggattacttttctggagttgataatgctgatttctgcaagaaaattggtcaaagcagccctttcctgcgggcagatataaaggtctttctgcagagcaattcacaggctcgatttacaccaagagccgttgcgagggtaatgcatggaattgcaagcccagcttatccttcaacagcatggagtaaaactcatttctggggaaggtatacgcatatagactttcaggtagtgatggaagcagcaaaggaagaacttaagaattttgttggaaaagatacactctag

SEQ ID NO: 3118 - DNA, 162 bp, Glycine Max
atggagtctcaaaaatctcaaaatcatgctaaaaaggcaaacaagtacattattatggaagttaccaagcgcaacatagcaccatgtagcaaaaactgcctaccgccagcatcaaatccttacaacagaggatgctccaggatatgcaaatgcagaaaatga

SEQ ID NO: 3119 - DNA, 1737 bp, Glycine Max
atggagtgtaggagaaagaaggagaatcaaaatcccaactccactttccctgatgaggtgttggagcgaatttcagggatgttaaagtcccgcaaggacaaaagcacggtttctttggtttgcaaagagtggtacaacgcagagagatggtcaaggaggagtgtgttcataggtaactgctactctgtgtctcctgagatcttaactcgcaggttcccaaacattagaagtgttacactgaaagggaagcctcgtttctctgacttcaacttggttcctgccaattggggtgctgatattcattcatggcttgtggtgtttgctggcaagtacccttggcttgaggagttgaggctcaagaggatgactgttactgatgagagcttggagtttctggctctccaattccccaatttcaaagcactttcccttctcagttgtgatggattcagcactgatggactggcttcaattgccactaattgcaagaatttaactgaacttgacatacaagagaatggtattgaggataagagtggcaattggttgggttgtttcccagacagcttcacatcattggaagtattgaactttgccaatctgcacaacgatgtaaattttgatgcactcgagaaactcgtctgtaggtgcaaatcattaaagactttgaaggttaacaaaagtgtgacactagaacagttacaaaggcttcttgttcatgttcctcagttaggtgaacttggtactggctcattttcacaagagttgacagcacagcagtgctcagatcttgaaagtgcgttcaaaaattgtagaaatcttcacaccctttcagggttatgggtagctacagcacaatatctcccagttctgtactctgcttgcacaaatctaactttcttgaattttagttatgctcctcttgacagtgatggtcttgctaagcttcttgttcactgtcctaagcttcagcgcatctgggttgtggacactgttgaagacaaggggctagaagctgttggatcacactgtccattgcttgaggaactgcgtgtttttcctgcagatccctttgatgagggcattgttcatggggttactgaatcagggtttattgcagtctctcaaggatgtccaagacttcactatgttctatacttttgccgtcaaatgaccaatgctgctgttgctactgttgtgcaaaactgtcctgactttactcatttccgactttgcatcatgcaccctggtcagccagattacttgacgcaagaatcaatggatgaggccttcggagctgttgttaagacttgcactaaactccagaggcttgcagtatcaggttatctgactgacctaacttttgagtatataggcaagtatgcaaaaaacttggaaactctttcggtggcttttgctggaagcagtgattggggcatgcgctgtgtgctggatggctgtccgaagctgagaaaactcgaggtaagggactgtccatttggcaatggggctcttctgtcaggcttgggcaagtatgagtcaatgagatcgctgtggatgtcagactgcaatttgacaatgaacggcgttagattgttggccaaagaaatgcctaggttgaatgttgaagtcataaaggaagaaacctatgagactcatcaggctaaaaaagtttacgtttatcgttctgttgctgggccaagaagggatgcccctccttttgttctcactctctga

SEQ ID NO: 3120 - DNA, 3240 bp, Glycine Max
atggagtgtttgaaatcccccttcctcttctccacttcacttctccctccaccttctcatcaaccctactccattacgccaaacataaagaacaagaagaataagaaacctcgagttcccatcttcattcgctgcaccatccagcgcgacccgtggtccccgacttccggcgaccccacccgacccaagcctcggagtcggaacccgaagaagccgctgtccgacgacaacgcgaggcgcatcataaagggaaaggcggcgtaccagagcatcctgcggcggaaccagggcccgcaggctcagaccccgaggtggattaagaggacccccgagcagatggtgcggtacctgcaggatgaccgcaacggccaattgtacggcagacacgtcctcgccgcggttaagaaagtgcgctctctctctcagagagtcgacggcgactacgacatgaggatggtgatggcttcgtttgtgggcaagctcagcttcaaggagatgtgcgttgtgctcaaggagcagaaggggtggaggcaagtcagagacttctttgcttggatgaaattgcagctgagctaccgtccaagtgtaattgtctacacaatagttttgcgcctatatgggcaagttggaaagctgaaactggctgaggagatcttcttggagatgcttgatgtaggttgtgagccagatgaagttgcttgtggtaccatgctttgttcgtatgccagatggggacgtcataaggctatgctgtctttttattctgctataaaagaaaggggaataattctttctgttgctgtcttcaactttatgatgtcttctttgcaaaagaaatcactccatagagaggttgtacatgtgtggaaggatatgctaggaaaaggggtgatacctaataattttacttatacagtggccatcagctcattcgtcaaagaagggctgcacgaagatgctttcaagacttttgatgagatgaggaattatggagttgttcctgaggagttaacttatagtctgcttataaatttaaatgctaaaagtggcaacagagatgaagtgcaaagactgtatgaggacatgaggtttcgaggaataattcccagtaattacacttgtgcttctcttctatctttgtattacaaatatgaggattaccctagagccctctcccttttttcagaaatggtacgcaataaaatttccactgatgaagtcatatatggtttgcttataagaatttatggaaagcttggtttatacgaggatgctcacaaaacatttgaagagacaaagaaccgagggcagctcaccagtgagaaaacatatttggcaatggcacaagtccatcttacttcaggaaatgtagacaaggccttggaagttattgaactcatgaagtctagcaatctatggttctctcgatttgcttatattgtgctgctgcagtgttatgtgatgaaagaagatgtagcatctgctgaaggaacatttctagctctctccaagacaggaccacctgatgctggctcctgtaatgatatgctcagtctgtacatgggacttaatttgacgaataaggccaaggagttcattgtccaaataagggagaatgagacaaattttgacaaggagctttatagaacagttatgaaggtttattgtaaggagggaatgctgccagaagctgagcagttgacaaatcagatggttaagactgaatattttaaaaatgacaaattcttcatgacattttattggattctttgtgaacataagggggatatggaatctgatgatgaacttgtggccattgagcccattgacaaatttaacgctacagctcttgggctgatgctcagtttatatctggcaaatggcaacttcaacaagacaaaaatattactgaaactgttgttgggttatgctgctgggggatcaaaaattgttagtcagctcatcatcaacttgtctaaagaaggagaaatcagtaaagcagaattgcttaaccatcaattaactaagcttggctgcagaatggatgaagccactgtagcttctctaattagccattatggcaaacaacaaatgctgaaacaagctgaagatatttttgcagaatatataaattctcccacatctagtaaagtgctttataactctatgatcaatgcatatgccaaatgtggtaaacaagagaaagcatatttattatacaagcaagcaacaggggaaggacgtgatttgggtgctgttggaattagcatcgctgtaaattctttgaccaatggaggaaaacatcaggaggcagagaatattgtccaaaggagtcttgaagaaaacttggagcttgacactgtggcttacaatacctttatcaaagccatgcttgaagcaggcaaattgcattttgcatccagcatttttgagcacatgatttcctccggtgttgctccatcaattgaaacattcaacacaatgataagtgtctatggacaagaccaaaagttggatagagcagttgagatgttcaaccaagctagctcatgcagtgtccctttggatgaaaaaacatacatgaatttgattggctattatgggaaagctggtttgatgcttgaagcatcacagctgttcagtaaaatgcaggaaggaggtataaaacccggaaaggtcagttataatatcatgatcaatgtatatgctaatgctggagttcttcatgaaacggagaaacttttccataccatgcagaggcaaggttatttgcctgattctttcacgtatctttcccttgtccaagcatatacgaggagcctgaattattctaaagccgaggaaaccatacatgctatgcaaagcaaaggcattccaccatcttgtgtccattttaatattttactccacgctttcataaaagctggattgattcatgaagccaagagggtttatgaggatctatcaacttttggtttagttcctgatcttgtatgtcatcgaacaatgctgaatggttacctgaaatgtggatatgtggaagaaggaatcaacttttttgaaagtatatgtgaatcaacaaaaagtgacaggttcattatgagtgcagctgtgcatttttacaaatctgctggaaagggaaggcaagctaaagaaatattaaatttaatgaacaacatggggatcccattcctcaagaaacttgaagttggatcaggagagagagtgaaaactccatga

SEQ ID NO: 3121 - DNA, 1245 bp, Glycine Max
atggagttcatatcaagagaaaccatcaaaccctcgaaccccacccctcctcacctcagaatccatcctctctccttcatagatcacatcgtttttcgcaactacatccccttgcttttcttttacaactccccaaaccatgagcaagcatccacaatatcaaaactcaagaaatccttatcccaagttttatcccgatactacccttttgcaggcaagctcagagatcaagtttccatcgactgcaacgaccaaggagtgtcctttctagtcacaaggctgagatgcaacctatcaacgatcctccaaaaccccacagaagaatcgttgaaccctttgttccccgatgaactacagtggaaacctatgagtagcagtagtagttcaagtataatagccatacaaataaactgttttgcatgcggaggaatagcaatgagcgtgtgcatgtgtcacaaagttggagacgcggccacactttcaaatttcatcaacgactgggccacacttaaccgccaaaaagaactagaacaagaaacagcagagttgttattattacccttcccagtacccggggcttcacttttcccgcaagaaaacttgcccgttttcccagaagttttgttcgtggaaaacgacaccgtatgcagaaggtttgtcttcgaggcctccaagatcgactccctcaaatccacggtgtcttcccacaacgtcccgaaccccacgcgcgtagaagtcgtcagcgcgttgatttacaaccgcgcggtttcggctctagggttgatttccaagacgacgtcgttccgcaccgccgtgaaccttcgcacgagaacggttccgccgctcccggagaagagcgtggggaacttggtctggttcctcttcgtgcttagcccttgggaaacggagctgcatgagttggtgctcaaaatgaaacaaggcttaaccgagttttctgcttcggttcccgaaccacagcctggtggttcggatgatgaggagagtcaaatagtaactatgttttgttgtgcgagttggtgcaggtttccgatgtatgaagcggattttggttgggggaaaccggtgtggttcaccactagtaagtgtcccgtgaagaatagcattgttttgatggataccagagatgggggtgggattgaagccatcgtgaacatggaggagcaagacatggccaggtttgagcgtgacgtggagcttctgaaatatgcttctcttaatcctgct

SEQ ID NO: 3122 - DNA, 1155 bp, Glycine Max
atggagttccaccgcagcgactcatcatcgtccccgtcttcatccacgcccacacccaacaacgccgatcccaataaaacctcttcttcagacccaatgcattcatggtgggaatccgtctctaaagcccgttcacgaatccacgccctcgccgccatcctcccctcctcctcctccgactccctctcctctctcgccgactccgaccgccctgctctctcactcttgtcctcccccgctgcctacgccgccgtctcctcttccctctccggctcccactccgaccccctctgccactggctctacgacaccttcctctcctccgacccccacctccgcctcgtcgtcctctccttcgtccccctcctctctggcctctacctctcccgaatccactcccctgaaccgccgtccctcgccgggttcgaagccgtcctcctcgccctctacgccgccgagaccaaatcccgaaacggcaaacccctcgtggtcacaatccccgacctctcccacccctccatctaccatgcgcccctccgcaaaccccaatcccaaaccctaaccctagcctcaacaccctcggttggactcatttcgccccctttagaaccccagctcggcgtcaaatccaccaagcgcgcctccatcgtcggcgttgcgctacactccttcttctcccagatctcccacatgcccgcctggtccaagctcgaattctgccaattcgccgcagcctgggccggctccgcccactgtccctgccgcaacgagctcgaccgcgatggcaaaatcgaggatttcgccaccgccattgagaacgttcgaattcgcgatggcgattatctggaagaagggaaaggggagaggattcccttgccgtgggagattctgcagccttcgctcagaatcctggggcactgtttattggggcctttgaactctcaggatgtgaaggatgctgcttcctttgcggtgcggtgcttgtacgcccgtgcttcccacgatttggtgccgcaggcaatactcgccactaggagtctcattcagcttgatgtgaggactagagaggctgccagggcgaatgccgccactaactcgaatgccaatacgcccaccaaggccaagaagccggagattcttctggtttccaagtga

SEQ ID NO: 3123 - DNA, 1155 bp, Glycine Max; identical to SEQ ID NO: 3122

SEQ ID NO: 3124 - DNA, 1086 bp, Glycine Max; identical to SEQ ID NO: 337

SEQ ID NO: 3125 - DNA, 933 bp, Glycine Max; identical to SEQ ID NO: 338

SEQ ID NO: 3126 - DNA, 2568 bp, Glycine Max
atggataaaacgacgaggaagctgatagacggcgttttgaagaacaccaacaaccctaaactggcatggcatcttgtcaaacgcgtcatctcttccccttcctcttcatcttcctcttccactcaacacctagtcaccatcacaacccgcatcctcgccaccgccaaaatgcacaacgaactccaccacctccacaatctcctcctatcctctcacaactaccacattgcacacccttccctcatttccatggtccgagtcctcgcccaattgggccacgtcgacgacgccattacacacttcaagtccctcagagcccaattcccatctctttctccttctcttcccctctacaacctcctcctccgctccaccctccggcaccaccgtcccggtttcgtctcgtggctatactccgacatgctcgccgcacgtgtcgcccctcagacctacaccttcaacctcctcatccattctctctgcgagtcgcgcgctttcgatcatgcactccaactgttcgaaaaaatgccccaaaaaggatgctgccccaatgagttcactctcgggatcctcgttcgcggcttgtgccgcgctggcctcgttaaacaagccttggagctcgttaacaataacaattcgtgtcgtattgctaacagggttgtagaggagatgaataatgaggctgagagacttgttgagaggatgaacgagctgggtgtgttgcctgatgttgttacgtttaattcgaggatttcggcgctgtgtagagctgggaaggttatggaagcgtctaggatttttagagatatgcagatggatgcagaattgggacttcctaggcccaatgttgtaacttttaatttgatgcttaaggggttctgcaagcatgggatgatgggggatgcaaggggtttggttgagaccatgaagaaagttgggaattttgactctttggaatgttataatatatggctgatgggtttgcttaggaatggagagttgttggaggctcggttggttcttgatgaaatggtggcgaaaggcattgagccgaatgcttacacgtataacattatgatggatgggctgtgcaggaaccatatgttgtcggatgcaagaggattgatggatctgatgatgaggaatggggtttacccggatacagttgcttatagtactctcctgcatggatactgcagcagagggaaggtttttgaagctaaaagtgttcttcatgaaatgataaggaatggttgtcagcctaatacttacacctgcaacacattgctgcatagcttgtggaaagaggggaggaccctagaggcagaggaaatgttgcaaaagatgaatgaaaaatgctatcagccggatactgtgacctgcaatattgtggtcaatggtctctgtagaaatggagaattggacaaagcaagtgaaattgtaagtgagatgtggactaatggaccaacttcccttgataaaggaaactcatttgccagtctaattaattcaatccacaatgtatcaaactgcttgcctgatggaatcacatacacaactttaattaatggactttgcaaggttgggagactagaagaagccaagaaaaagtttatcgagatgttggcaaaaaacttgcgccctgattctgtgacctatgatacgttcatatggagtttttgtaaacaagggaagatatcatcagccttccgcgtcttgaaggatatggagagaaatggttgtagtaagactcttcaaacttataatgcattgatcctgggtttaggaagtaataaccaaatatttgaaatatatggattgaaggatgagatgaaagaaaaagggataagtccagatatttgcacttataacaatattatcacttgcctctgtgaaggaggaaaggcaaaggatgccatttctcttttacatgaaatgttggataaaggtatatctcccaatgtatcctccttcaaaatattgattaaagctttcagcaagtctagtgattttaaagtagcttgtgaactatttgaggttgctttgaatatatgtggccgcaaagaagcgttgtacagtttgatgttcaatgaattacttgctgggggacaactctctgaagcgaaggagctatttgaaaatttcatgtataaagatttgattgcaagactttgccaggatgaaaggttggcagatgctaatagccttctttataaattgattgataagggatatggcttcgatcatgcatcattcatgccagtgattgatggcttaagtaaaagaggaaacaagcggcaagcagatgaactagcaaaaagaatgatggaattggaattggaagacagacctgttgataggacttattcaaacagaaagagagtcattcctggaaaactacttaaagatggaggaagtgactggcaggacataattaacagggatgctggcagtggaattgcactgaaaactcttaagcgtgtgcagaaaggctggggccaaggaagtatatctagtttacagcctcagcagaatgattttcttgattactatgatggtagtggttaa

SEQ ID NO: 3127 - DNA, 1155 bp, Glycine Max
atggataaagtcttcaacaagctccgcaatttggacgcttacccaaaagtcaatgaagatttttacaaccgcacgctcgccggcggcgtcgtcaccgtcgtttccgccgctgtcatgctgtttctcttcttctccgagctaagtttatacctctatacagttacggagagtaagcttttggtggatacttcaaggggagataccttgcacatcaattttgatgtcacttttcctgctgttcgatgttcaatactcagtttagatgcaatggatatcagtggcgagcagcatcttgacatacgacataatatagtgaagaaaagaattgatgctaatggtaatgtgatagaagagaggaaggatggaattggtgcaccaaagattgagagacccttacagaaacatggtggcagacttggacatgatgaaaagtattgtggttcatgttttggtgcagaagagtcagatgaacactgttgtaattcttgcgaagaagtgcgtgaagcatataggaaaaaaggctgggcaatgacaaatatggatttgattgatcagtgtcaaagagagggttatgtgcaaagggtaaaggatgaagaaggtgaaggatgcaatcttcaaggatctcttgaagttaataaagtagcaggaaattttcattttgcaactgggaaaagctttcttcagtctgctatatttctggctgatgtgcttgctttacaggataatcattataatattagccatcggatcaacaaattaagttttggtcaccatttccctggattggtaaatcctcttgatggggtaaggtgggtgcaaggacctactcatggcatgtaccagtatttcataaaggtggtccctacaatatacacagacattagaggtcgtgttatccattcaaatcagtattctgtgacggagcatttcaagagttcagagctgggtgttgcagttcctggagttttcttcttttatgacatatctccaatcaaggtcaactttaaagaggaacatactccatttttacatttcctgaccaatatttgtgcaattattggaggtgtatttactgttgcgggaataatagattcatcgatatattatggtcagagaacaatcaagaggaagatggagcttggaaaatttacatga

SEQ ID NO: 3128 - DNA, 1884 bp, Glycine Max; identical to SEQ ID NO: 339

SEQ ID NO: 3129 - DNA, 816 bp, Glycine Max
atggataaatcagagcagactcaacagcagcagcagcaacaacagcatgtgatgggagttgccgcaggggctagccaaatggcctattcttctcactacccgactgcttccatggtggcttctggcacgcccgctgtaactgctccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccatagccttcctcttgctcggataaaaaagataatgaaagctgatgaagatgtccggatgatttcagcagaagctccggtcatatttgcaaaagcttgtgaaatgttcatattagagttgacgttgcgatcttggatccacacagaagagaacaagaggagaactctacaaaagaatgatatagcagctgctatttcgagaaacgatgtttttgatttcttggttgatattattccaagagatgagttgaaagaggaaggacttggaataaccaaggctactattccgttagtgggttctccagctgatatgccatattactatgtccctccacagcatcctgttgtaggaccacctgggatgatcatgggcaagcccattggcgctgagcaagcaacactatattctacacagcagcctcgacctcctgtggcgttcatgccatggcctcatacacaacccctgcaacagcagccaccccaacatcaacaaacagactcatga

SEQ ID NO: 3130 - DNA, 1077 bp, Glycine Max
atggataacagcaccctgaacaatcccggcgacaacgccgaagacccgccaccgccgccggctcccatgcaagtctttgattccttccaaccgttccattacgccaacggttccgatgaaggagaagaagctgttcctgctccagtcgccaatgcttcttctgctatgcgcgccagagctagcgaactcaccatttccttcgaaggcgaagtctatgttttcccagccgttacgcccgaaaaggtgcaggctgtattattactcttgggagcacaggagatgccaaatagtgcccccacctctgactttttgttgcagcaaaactatcaggacattcgggaaataaatgatccttcccgaagttcaaagctttcaagaagatttgcatcacttgttaggtttcgtgaaaaacgaaaggagagatgttttgagaagaaaattcggtactcttgccgtaaagaggttgctcagaggatgcatcgtaagaatggacagtttgcatcattgaaggaagactacaaatctcctgctgaaaattgggattcaagcaatggtactccttgcccagactctactgagcgtagatgccagcattgtggaattagtgagaagtctactccagctatgcgtcgaggaccagcaggtccaagatctctgtgcaatgcctgtgggctcatgtgggcaaataagggaactctgagagatctcagcaaagcaggaaggattgcttttgaacaaaatgaactggatacttcagctgatataaagccttcaacaacagaagccaaacattcttatgctaagcagggcaaggagggaagccctgaagaaactaagcctgtgcaaatggattccagacggtcacctgagaagacaaatgagcagtttattattggaactgctgaatcagttactaacaacttgtccgtccgattggagaatcatgctcttattctacatgagcaggatactcttgaggatcttgctgatgcttctgggaccgaatttgagattcctgcaggttttgatgatcaggttgacattgatgatgccaatatgaggacttattggctgtga

SEQ ID NO: 3131 - DNA, 978 bp, Glycine Max
atggataatgccacatttcgcagtttccttcaggttcttccccctgttgaatttgcatgcgtctatggatcatctcttcatccatccaaccacgacaagacaatcatgacagattatattcttggcgtatctgatccaaaacagtggcattctgagaatctgaaattgaacaagcatcactatgcgtcatggatggtgcaccttggtggcgagagcctgattactggagttgctgatagaattggtgtgggagtgcatttcaacccttttgttacttggaatggaaagctgttcaagtatggggttgttcgaatgcatgacttacttcaagacgtacagtattgggagaaattctacttgtgtggccggttacagaaaccagttcatattgttgtcgataatttagatgtcagcagcaccaattctgttaacttgagagctgcagtgtcagctgctcttctcctgcttccatcagaattcacagaggcagatctatatgccaaagtatgtagtctttcatacacaggtgatatacgcatgttatttgctgaggataaaagcaaggtgaaaaagattgttactgggcagtttgatctattccacttaatgtataagccatttctcgaagaatatgaggctaagaagttattgagactttcatcaactgccaagaatcaaatacatgtctctcaggattgtgacttatcagttgcttgttctctagtttctgctcttccttcatcaatcagaagccagatcagcatgaaagaagaaataagggaaactggtagagtcatacctgatactaaagttagcacaagagaagcagctgcgaattgcttgcagagaattctgaggcaaagagtaatggtttcaagtgcaaggcaggccatatcaggctttctggctgttggtggggtaaatgctaccagatatcttgctaagaaagttaacaaagcctggaaatcatggagctga

SEQ ID NO: 3132 - DNA, 162 bp, Glycine Max
atggataattcggatcctagaaatacgtccaacggtataggatacaagcaatcaccttcgaataaaaagaaggatgagaagaatgagaaaaagaaggatgagaaggatgagaagaaaggtggtaagaagaagagtgttcaaggtggtctttctcctaattaa

SEQ ID NO: 3133 - DNA, 894 bp, Glycine Max
atggatacaggtgagacagttgctgttaaagttcttggcactaattcaaggcaaggggaacaggagtttttaactgaggttttattacttggaagattacatcacaaaagccttgtggatttggtgggatatgtggcagaaagaggaaaacatatgcttctttacatttacatgagcaatggcagtcttgattcccatttatatgctgatttgggaaaaaatcacaagccattgagctgggatttgaggcttagcatagcgctagatgttgcaagaggactggaatatctacatcatggggcttctccacctgttgtgcaccgtgacatcaaatcttgcaatatactgttggaccagtctatgagagccaaggtcactgattttgggctttccagaccagagatgatcaaacctcgcacatcaaatgtcagaggaacttttggatatgttgatcccgagtatttgtctacaagaaccttcactaagaaaagcgatgtttatagttttggtgtgctactgtttgaacttatcactggcaggaatccacagcaagggctcatggaatatgtaaaactagcagtcatggaaagcgagggtaaggttggatgggaagaaattgtggacccacaattaaatggaaaatatgatgtgcataatcttcatgacatggcttcacttgcattcaaatgtgttaatgaagtctccaaaagccgaccttcgatgtgcgaaattgttcaagaattatctcagatttgtaagaggcaaattaaagatcatggtggaacatctcctgctgcattgaaggaagtgtccattgaagtgggccagactgaaattcaggacttctcatcaattgagagttcaaagatggtgcgcagattgcatagccgatga

SEQ ID NO: 3134 - DNA, 794 bp, Glycine Max; identical to SEQ ID NO: 340

SEQ ID NO: 3135 - DNA, 156 bp, Glycine Max; identical to SEQ ID NO: 341

SEQ ID NO: 3136 - DNA, 786 bp, Glycine Max
atggatagtaagttcagaaaaaacaaccgcaactcatataccagtgaacaagatcaagacactgatcatgatgtagctcaagaaaacattgccgagtcccctccttcttccactgtgttcaacatcgatggcttagtcccatcccccaccccttcatcaaagagaaggagggcaatacagaaaagggtggtgcaaatcccaatgaaggagacagaagggtgtaggctaaaaggagagagcaacaccccaccctcggattcatgggcttggagaaagtatggacagaaacccatcaagggttccccttatcccagagggtactacaggtgtagcagttccaagggctgtccggcacggaaacaagtggaaaggagctgcgtggaccccacaatgctagtcgtcacttactcctccgaccacaaccatccatggccaccttctagaaaccacgccaggcccaccaagaagcctgaaccggttccggacccggtccaacccgaaccggaggagaagttcgcggacctgggcggggacgactccatgataaccaccgcggaggaattgggctggctgggggagatggaaacgacgtcatccacggtgctcgaaagccccattatggccacgggctaccacgctgacgtggcgctgattccgatgagggaggaggacgagtcgctcttcgccgacctcggggagctgccggagtgctcggtggtattcaggcaggggctgctgacggagcggcggcggtacaccgcgccgtggtgcgggaccacaagttga

SEQ ID NO: 3137 - DNA, 618 bp, Glycine Max; identical to SEQ ID NO: 342

SEQ ID NO: 3138 - DNA, 1344 bp, Glycine Max
atggatcatcaaaacaaacacgtagcagtctttgctttcccctttggcagccaccttatgcctctcttaaaccttgtcctcaaactagctcattcccttccaaattgttcattctcattcattggcacagacaaatccaatgcaatccttttcccaaaaccccacatcccaaataacatcaaggcctatagcataagcgatggaatcccagagggtcacgtcctaggcaaaaacccaactgaaaagttgaatctttttctccaaactggtcctgagaacttgcacaaaggtatagaacttgcggaagcagagacaaagaagagagtcacatgcatcgttgcagatgcttttgtaacctcttctctctttgtggctcagaccctcaatgttccttggattgcactttggcttcccaattcatgctcactctctctatatttctacactgaattgatacgtcagcactgtgcaaaccatgctgggaacacaaccttggatttccttcccgggttgtcgaagctgcgtgttgaagacatgccacaggatctgctcgatgtgggagaaaaagaaacagtttttgcaagggaactaaattcactaggtaaggtgctacctcaagctaaggtagtagttatgaatttctttgaggagttggagccacctttgtttgttcaagacatgagatccaagttgcaatctttgctttatgttgttccacttccttccacgttattgccaccatctgacacagattcaagtggatgcttgtcatggttggatacgaagaattctaaatcagtggcttatgtttgctttgggactgtggtggcacctcctccacacgagcttgtggcagtggcagaggcactcgaagaaagtggatttccatttctttggtcactgaaggaaggtctaattggtcttttgccaaatggatttgttgagagaaccaaaaagcatgggaaaatagtgtcttgggctccacagacacaagttttggcacatgattctgtaggagtctttgtgactcactgtggagctaactctgttattgagagtgtttccagtggtgttcctatgatctgcaagccattctttggggatcaagttgtggctgcaagagtgatagaagatgtttgggagattggtgtcataatggaaggtaaggtgttcacaaaaaatggattggtgaaaagcttggatttgattttggtgcatcaagaggggaagaagattagagacaatgctcttaaggtgaagaagactgtggaagatgcaggtaggcctgaggggcaagctgcacaggatttcgacactctggtggaagtaatttctagatcttaa

SEQ ID NO: 3139 - DNA, 225 bp, Glycine Max
atggatcatggaaagcacttcagtggcagtggcagtggaatcaacaagaatgaaagtaaagataggaagaagttattgatgagcagacaaatagttttggggaatgagaaagaagacatcaacaaaatggctgatgcgttcatcaacaacttccgcaaacagttgaagattgagagagaaaattcgttcaaacgttttcaggatatgatacacggaggcgcatga

SEQ ID NO: 3140 - DNA, 372 bp, Glycine Max
atggatccagacgcgttggcaaaggcattcgtggagcactactacagcaccttcgacaccaacaggaacggcttagcgaatctctaccaggagggttccatgctcactttcgaagggcagaagatccaaggcgcttccaacatcgttgccaagctcacctccctcccttttcagcagtgccaccactcaatctccaccgtcgactgccagccctccggcgtcaacgccggcatgctcgtcttcgtcagcggaaaccttcagctcgccggcgaacagcacactctcaagttcagccagatgttccatttgataccaacacctcagggaagctattatgtgttgaatgacatattccgtttaaactatgcatga

SEQ ID NO: 3141 - DNA, 1416 bp, Glycine Max
atggatccagtaagcgtgtggggtaacacgcccttggcgacggtggatcccgagatccatgacctcatcgagaaggagaagcgccgtcaatgccgcggaatcgagctcatcgcctccgagaacttcacctccttcgccgtcatcgaggccctcggcagcgctctcacgaacaaatactccgagggcatgccgggcaaccgctactacggcggcaatgaatacatcgaccagatcgaaaacctctgccgctcacgcgccctccaagccttccacctcgacgcccaatcctggggcgtcaacgtccagccctactccggctccccggccaacttcgccgcctacaccgccgtcctcaacccccacgaccgcatcatggggctagatctcccctccggcggccacctcacccacggctactacacctccggcggaaagaagatctccgccacctccatttacttcgagagtctcccttacaaggtaaactccaccaccggctacatcgactacgaccgcttggaagaaaaagccctagacttcaggccaaaactcataatctgcggtggcagcgcgtaccctcgcgattgggactacaaacgtttcagggaagtcgctgataagtgcggagcattgcttctctgcgacatggcgcacactagcggccttgtggccgcgcaggaagtgaacagccccttcgagtattgcgacattgtgaccaccacgactcacaagagcttgcggggcccacgtgcggggatgatcttttaccggaagggccccaagccgccgaagaaggggcagccggagaacgcggtttatgatttcgaggacaagattaacttcgcggtgttcccttcgctgcagggtgggccccacaaccaccagatcggtgctctcgccgtggcgctgaagcaggccgcgtcgcccgggtttaaggcctacgcgaagcaggttaaggcgaacgccgttgcgcttggaaaatacttgatggggaaagggtacagccttgtcactggcggaacggagaaccatcttgttttgtgggatctgagacctcttggattgactgggaataaggtggagaaactctgtgatctctgtaacattactgttaacaagaacgctgtttttggtgatagcagtgccttggcccctggtggagtgcgaattggtgcccctgccatgacttctaggggtttggttgaaaaagactttgagcagattggtgagttccttcaccgtgctgtgactctcacactggagatccagaaggagcatggcaaacttctcaaggatttcaacaagggtctcgtcaacaacaaggctattgaagatctcaaagctgatgttgagaagttctctgccttgtttgacatgcctggcttcctggtatctgaaatgaagtacaaggattag

SEQ ID NO: 3142 - DNA, 1509 bp, Glycine Max
atggatccagtaagcgtgtggggtaacacgcccttggcgacggtggatcccgagatccatgacctcatcgagaaggagaagcgccgtcaatgccgcggaatcgagctcatcgcctccgagaacttcacctccttcgccgtcatcgaggccctcggcagcgctctcacgaacaaatactccgagggcatgccgggcaaccgctactacggcggcaatgaatacatcgaccagatcgaaaacctctgccgctcacgcgccctccaagccttccacctcgacgcccaatcctggggcgtcaacgtccagccctactccggctccccggccaacttcgccgcctacaccgccgtcctcaacccccacgaccgcatcatggggctagatctcccctccggcggccacctcacccacggctactacacctccggcggaaagaagatctccgccacctccatttacttcgagagtctcccttacaaggtaaactccaccaccggctacatcgactacgaccgcttggaagaaaaagccctagacttcaggccaaaactcataatctgcggtggcagcgcgtaccctcgcgattgggactacaaacgtttcagggaagtcgctgataagtgcggagcattgcttctctgcgacatggcgcacactagcggccttgtggccgcgcaggaagtgaacagccccttcgagtattgcgacattgtgaccaccacgactcacaagagcttgcggggcccacgtgcggggatgatcttttaccggaagggccccaagccgccgaagaaggggcagccggagaacgcggtttatgatttcgaggacaagattaacttcgcggtgttcccttcgctgcagggtgggccccacaaccaccagatcggtgctctcgccgtggcgctgaagcaggccgcgtcgcccgggtttaaggcctacgcgaagcaggttaaggcgaacgccgttgcgcttggaaaatacttgatggggaaagggtacagccttgtcactggcggaacggagaaccatcttgttttgtgggatctgagacctcttggattgactggtaatatatataggattggatctctaccttctggttttgatttgttacaaatgtctataaatctgacttgttcgttgtgtgattgttttgcagggaataaggtggagaaactctgtgatctctgtaacattactgttaacaagaacgctgtttttggtgatagcagtgccttggcccctggtggagtgcgaattggtgcccctgccatgacttctaggggtttggttgaaaaagactttgagcagattggtgagttccttcaccgtgctgtgactctcacactggagatccagaaggagcatggcaaacttctcaaggatttcaacaagggtctcgtcaacaacaaggctattgaagatctcaaagctgatgttgagaagttctctgccttgtttgacatgcctggcttcctggtatctgaaatgaagtacaaggattag

SEQ ID NO: 3143 - DNA, 1287 bp, Glycine Max; identical to SEQ ID NO: 343

SEQ ID NO: 3144 - DNA, 804 bp, Glycine Max
atggatccgaagctgaaagaggtttctcagctcttcgatcgcttcaaggcttcgtttctccggaacgacttcgataactgttccaatctcctttctcagctaaaggtgttacttacaggtttcagaagcctgccaccgttgtttgcagatacacctaatgcagttcatgaattaacaatagcaagggatatatatgagcatgctgttgtccttagtgtgaaaattgaggatcaagatgctttcgaaagggatttcttccagttgaagccttattatacagatgcctgcaatcgtcttccaccatctcctcaggagtaccctatactgggtctcaacctgttgagactacttgtgcagaataggattgctgagttccatactgagttggaattgctttcatctgctgctcttgagaatccttgcattaagcatgccgtggagttagaacaatcttttatggaaggggcttacaatcgtgtcttgagtgcacggcagacagtgccacatgatacatacgtttatttcatggatcttttggcaaagactgtcagagatgaaatagcaggttgcagtgagaaggcctatgactatctttcaattaaggatgccaagcaaatgttgctgttctcctcagaccaggaactcctggaatatattaaagaggagcatcctgagtgggagattaagaatgatagtgtctttttccaaaaggcaaaagaatctgcaccttgcaaagaaataccctctctgcagctcatcaaccagacacttagttatgctagggagttggagaggattgtctga

SEQ ID NO: 3145 - DNA, 3345 bp, Glycine Max
atggatcctgaggtgcagcaatcgcaggtcgccgccattcttggcgccgatccctcccccttccagacactgatctcgcacctcatgtcctcctccaacgagcaacgctcccacgcagagactcttttcaacctctgcaagcaaaccgatcccgataacctctccttaaagcttgcacatctccttcactcctcgccgcaccaggaggcacgggccatgtccgccatcctcctccggaaacagctcacccgcgacgactcttacctctggccgcgcctctcccctcagacgcagtcttccctcaaatcgctcctcctctcctcgattcaatcggaaaacatcaaatccatctccaagaagctctgcgacaccatctctgaactcgcctctggtattttacccgacaacgcctggccggagcttcttcctttcatgttccagtgtgtttcctccgattcccctaagcttcaggaatccgcgtttttaatcttcgcgcagttgtcgcagtacatcggcgattccctcactcctcacatcaagcacctccacgatatctttttacagtgcctcacgaacgctaccgttaaccctgacgtccgaattgcggcgcttaacgccgttatcaatttcatccagtgcttatccggttccgccgatcgcgaccgcttccaggacctgctgcccgcgatgatgcggacgttgaccgaggcgcttaattccggccaggaggccaccgctcaggaggcgctcgagcttctcatcgagctcgccgggaccgagccgaggtttctgcggaggcagcttgtggatgtcgttggtgctatgttgcagattgctgaggccgagtcgcttgaggaagggactcggcatttggcgattgagtttgtgattaccctcgcggaggcgagggagcgcgcccccgggatgatgaggaagttgccgcagtttattagtaggttgttcaccatactcatgaaaatgcttcttgatatcgaggatgatcctgcgtggcacagtgctgagactgaggatgaggatgctggtgaaaccagtaattatagtgtgggacaagagtgcttggataggctctctatatctttgggtggaaacaccattgttcctgttgcgtctgaacagttgcctgcttacttggctgctcccgaatggcagaaacgccatgctgcacttattgcacttgctcagatagctgagggctgctcaaaggtcatgataaagaatttggagcaagtggtggctatggtcctgacttccttccctgaccaacacccccgtgtaaggtgggcagctattaatgcaattgggcagctgtctactgatttgggtcctgatttgcaagttaaatatcatcaaggagtgttgccagcactagctggtgccatggatgattttcagaaccctcgtgtgcaggcacatgctgcttcagcagttctcaacttcagcgagaactgcacacctgatatcttaacgccatacttggatggaatagttagcaaactacttgtacttcttcagaatggtaagcagatggtgcaagaaggtgccttaactgctttggcatcagttgctgattcttctcaggaacacttccaaaaatattatgatgctgtaatgccatatctgaaagctatattggttaatgcaaccgacaagtctaaccgtatgcttcgtgctaagtccatggagtgtataagtttagttggaatggctgttgggaaggagaagtttagggctgatgctaagcaggttatggaagttcttatgtcccttcaagtatctcaaatggagacagatgatccaacaacaagttacatgctacaggcatgggctagactctgcaaatgtctgggacaagattttcttccttacatggagtttgtcatgcctccactacttcaatctgctgcacttaagcccgatgtaaccattacatcagcagattcagacaatgatattgaggattctgatgatgaaagtatggagactattactcttggggacaagcgaattggaatcaagactagtgttctagaggaaaaagctacagcatgtaacatgctttgttgctatgctgatgagctgaaggaaggattctttccatggattgatcaggttgctggaactttagttccactccttaaattttatttccacgaggaggttagaaaagcagctgtttcagcaatgccggagctattacgatctgcaaaattagctattgagaagggacaatctcaaggtcgggacgtaacctatttgaaatttttgactgacagtatcatcccagctttggtggaagcattgcacaaggaacctgacacagagatttgtgcaagcatgttggattcattaaatgaatgcttacagatatctggaatgcttttggacgaaagccaggtcagatccatcgtggatgagataaaacaggtgatcacagctagttcaagtagaaaacgagagagagcagagaggacccaagctgaagattttgatgctgaagagggggacctgattaaagaggaaaatgaacaagaggaagaagtttttgatcaagtgggtgagatattaggaactttaatcaaaaccttcaaagccaacttcttgcctttctttgatgaactatcatcatatctgacacctatgtggggaagggacaagactcctgaagagagaagaattgcaatttgtatttttgatgatgttgcagagcagtgtcgtgaagctgctattaagtattatgatacctatctcccattcctgttggaggcttgtaatgatgagactcctgatgtcagacaggcagctgtgtatggtctcggtgtttgtgcagagtttggtggatctgtgttcaaacctctggttggagaggctcttttgaggttaaatgctgtgatccagcatcctaatgctcttcattcagataatgtaatggcatatgacaatgccgtttccgctctgggaaaaatttgccaatttcatcgtgacagtattgattctgcccaggtagttcctgcatggctaaactgtttgccaatcaaaggtgatttgattgaggccaaagttgtgcatgatcaactttgttcaatggctgagagatctgacagtgagctgttgggtccaaacaatcaataccttccaaaaatagtttcagtgtttgctgaggttttatgtgctggtaaggaccttgcaacagaacagacagctggtcgtatggttaatttactcagacagctccagcaaactttaccaccctctacacttgcttctacttggtcatctttgcagccccagcaacagcttgcattgcaatctatcctttcttcatag

SEQ ID NO: 3146 - DNA, 327 bp, Glycine Max
atggatctagaaggcaaaaaatttgggaggggcaacaaagaacttggaggtactcgtgatctcataaatcagtatagactttggccctactatgaattcttctgcaagaagtcactcccagtgtcaatttcagagacacattatcttcacaatgtggtgggtgacacaaaaatcaggaagggagaaggaatggaactggatcagctctgtaaaaacacagacacgagtgagaaaaaagcttgcttatgtccttttgacttggatgtactcagtgaagctttccatatgagggatatgaatccagtccacctttcttctacgcattga

SEQ ID NO: 3147 - DNA, 345 bp, Glycine Max
atggatctagaaggcaaaaaatttgggaggggcaacaaagaacttggaggtactcgtgatctcataaatcagtatagactttggccctactatgaattcttctgcaagaagtcactcccagtgtcaatttcagagacacattatcttcacaatgtggtgggtgacacaaaaatcaggaagggagaaggaatggaactggatcagctctgtaaaaacacagacacgagtgagaaaaaagcttgcttatgtccttttgacttggatgtactcagtgaagctttccatatgagggatatgaatccagtccacctttcttctgtaagatttttgtggctgcacatttga

SEQ ID NO: 3148 - DNA, 1455 bp, Glycine Max
atggatctcattcgtgtgtttttcactctatggtttactttgatacttttgaaccataattttggaaatgtggagggaagataccaccatcacaccaagcagaagaaagtttccactgctcctaatgattcttctgattctccaagtgttccttccgacccttcagcttcaccaccttctaattctcctagtccttctaattctcccagtgttccttctgacccttatccaaatgataaccaaacttcctcttctgactgtgttttcgatgtgagatcctttggggctgttggagatggctgtgctgatgacacacgtgcattcagagcagcatggaaagcagcatgtgctgtggactctgggattgttcttgctccagaaaactacagctttaaaatcacttcaactattttttcaggtccatgcaagccaggattggtattccaagtggatggaacactaatggcaccagatggaccaaattcgtggccagaagcagatagccgcaatcaatggcttgtattttatcgacttgaccaaatgactcttaatggtacaggaaccattgaagggaatggagacaaatggtgggatctcccctgcaagcctcacaggggtcccaatggaaaaactttgtcagggccatgtggtagtcctgctatgatacggttcttcatgagctccaatttgaaggtgaaggggttgaaaattcaaaacagtcctcagttccacatgatattcaatggctgccaaggagtactgatcgataagctctccatttcttcaccaaaactcagccccaacaccgatggaatccatgtagaaaattccaaatatgttgggatatataattccatgataagcaatggtgacgattgcatttcaattggacccgggtcctcaaacgtggacatagctggtttaacttgtggtcctagccacgggattagcataggaagccttggagtgcacaactcccaggcatgtgtgtccaacttaactgtccgtgacagcatcataagggaatcagacaacggactcagaatcaagacatggcaaggtggaatgggatcagtgtcaagtctgagattcgagaacatccaaatggagaacgttggaaactgcatcataatagaccaatactactgtttgtcaaaggaatgtctaaaccagacttcagctgtgcatgtgaatgatgtgtcctacagcaacataaagggaacctacgatgtgagaactgctcctattcactttgcttgcagtgacactgttgcctgcacaaacataacactctctgaggttgagcttttgccattcgaaggagcattgctggatgaccctttttgctggaatgcttatgggacacaagagaccttgactatacctccaattaattgcttaagggagggtgaccctgaaacagtgggcgatctttctgaatatcaatgcagttaa

SEQ ID NO: 3149 - DNA, 5508 bp, Glycine Max
atggatcttcgttgttgggagatattcaagttctgtttgcaggagtctttgaagttccacgtctctttgagtattccccggaacctcctacaaacggttcagttcgttgccagaaatgttctgtcactgctagaggattcctctatcagttcaggagaactttttatatctgatgaaaggtataaactgtgtgataccactcttgactgtgtttcattggttttctcgtctcatggtgggttgtcaaataaaaacttggacttgtgggttgaaacagccagggtgttgcttgaacttgtgcttaaaatgtatagcaataaacttgatggcagcgacgtgggtgcttatgcactacgctttctgtggtcggtgcttcagccattctctaagttgagggtccatctagctaagaaaggatttcataactttgtggataaacttcttgagccactgttgcatttatcaggagagttgcatcttcaggttaatgaaagtaatcccatttgggcgtcgagattaatggaggcggtggaagaagttctttctcatggactgtttcatcacatgcatattcctgagtttttaagcttgcatgtttcagaaaacgatgatgcttcatgtgatgataagtcaaatgactcaaaggcaactattaagagttatactagacatttatttgatgtactgaacaaaattatagctaagaagaatgatatggcaatgggtagcttaggcttgttatttcacttgtatgttaattcagcaagaaaattcaaactggatgaagggcaccagacagtggagaatatagatggttcaaggcaaccagtgccaggaaaacactgtagctcaaataatatttctgcagaccttcaaaactcacttttcaatttttttgtactgattatggaaccccttttgctgaagattaatgcctatattcaagttgaagtagatgctaatcccctgttgttggattttcatgctttactcaagtctattggtaaattacttgctagttttatgcaagacaaagtttatgtgagaaccgaggacacatctggaggagcttgtcttaatttcttgaagaaaatatttaatacactgatgactagtttcactagtgtacttcacttctccaactatgatacaaccaacaggacggagatatctagtactttgcctgctaacgagattctagttgctatgggatatcttttgcaaattgaatatgaggttattggagaagacttggtaaatctgtggcttctcatgttgtcatgctctgccatcaattgcaatttggtgaatgttcctgaccaatgcccattaccttccactatacctgccctgggatgccaaacaatttatctctacagtcaacttcgccaggtggaaattgctattttagcattgtgcaaagcaataaggcttgttatatctcacgagggtaatactgagggttcttccaggttcttggtatttctgtcgaatgaatttcattctgaagcagttgaaaggctgttatcttcagagaagttcatcaatgccatttataaagctgttgaatctattcccgaagggcaagtatgtggttgtattagacaaataacagaagatatttcagaatctctcaggtggatgaaagatttctgtccattggttgatggcaagaaattgcaaatttttaatctgcaaggggaactgctgggtagagggctgtctagactgtattgtttagttcttggttcggttattatcaccaacagcaaccgcaatcttcttggggttgctgtaaatgaacttatggcattagtgcgtccctacttgagtattctagttgggcaacaaccagatacaatctgcaagttcttttcttctgtcataggagaaactgttgatcaggtggttagaaagggaaaagttttaaagaaatttggtaggtccagtcaatgggtccttgtgttcttctttcagttgtttgtgtcctgtcaaagcttatataggcaagcaagccttaggcctcctgatatgccaaagatgtctgcagaggtggaggattacacaacatattctgcctctgagttgatggagaggattgatgagatagactttggttatttttcttggattgttcaaccctcttcttccctccttgttgttatgcaatttatttctgacatatatcttaaacttggctcagatgatttttcccctttgatctatatatttcagtctatggctcttcgaaggcttgtttacttgaataagcagattaaattgttcaagtatttaaaaaagaaacattatttgcaaaagaagtcttatagatctcaaatcaagacactgaaagaagaggcggctggccttactaattttattttggagtatttatcgtgtgtgtatcaatccccaatctttgtttctgattatgtaacttgtgaagatgtagtttctgtggtcactcaaagcatccaagaccacataaaagaaagatgcaaccaatgggattgggatctaggagtgtatgctgctaacaaaaaatcattgccaacactcatttggtcaaagctttgcaaaaatgttaatatttggagcaaccatgcttcaaagaagcaattgaaaacattcttctcacatttactccatgcttaccttcacagtgtaacaagtagttttcaagagccaggtgtgcaagaaattgacaagtgtaagctgctcaagatggtcactttgtcacaaatatcatcagaacttctgaatgattcccttttttacgaacaaaaatttgtttacaggagtctggcctcgatgttttgccatgctttagagaaatctgtgctcccattatttagtaacattccatgtactgatgtcaatcttcagtcattgcctaattggccagagtttttaagttcccttgacaactcagcaatgcttgttgataaaaataaagaaattctggtcgattcttctgcagtggaaagttcaaccactcattcatgtgacaaacttcctgcagatatcagcagaaaagacaagactttccctgtcactgacaaaatttttagagattgccaccatttgcttgatctcttatgtcggatgcaagataaaaatgcgagatcattttcacatcttctgacttgtattttcaaccttgaacgattatttgtctcttgtcggaagacattatggcatatattaattggattttatgataaggcaaacactatcccattctcgccaaactcgattatttctggaagttcgctacctgtattgtggctttcaaagtcattatctgtagttgttgggattaaagaggcacactcaaccaaaaatattattctcttaaagaagctgagatgccttgactcccccaagcttgaggcattgaaatgtttaacctttatggctgagaatttgagagagcagatacagagcttgcttgtttctgttcacaataccccttgcaatgtcaatgtgggatttggtcttacttatgaaagcattaatagattgtcctcttcagcttgttgctttagtagacttttgtggggcctactcacatcttccacgggccaaacagatgctaaagatagtgatgaaaaagaaaaagtgttgatgtggaaaagtgagcatgcctctgaactggacagttgtatatcttctcttagtaatcaactttccaaaagttcacacaatacacaacattttgaagatccagccgtgaagttatccttgtcaagtaccaattatttgtcatctaaaagtttagtttctaaggctaatgccttagttggtacacaaaatgaatctacagctgcagctagttgctttacttcatcagctgttgataatgtctccaaaagtgtcagtaatcatgggagaatggttttggccagggtggaatccactgagctacagggtttgaataagcctttgttgcaaagcttggtaaaaggtgatcaccctgaaatagcttttttgctgagacaattgttaattgttttctcatctcttttgaggttaaatttgctgaaagatgatggtttcttaccttctagttttgtacctactttcattgaaatttcacaagtcctgttattagaatttacagagatggttgtggtcccacaatattctgctttgcttttgttagatggtgcttgcaactatttgagagaattagcgggttattttcctttcactgatcctacctcctctagaaaagtttacacaaaattgatacagattcacatgagggcaataggcaagaccatttcgttgcaaggaaaaagggcaacactaacctttcatgaaagacagtcaagtaccaagtcacttcataaaggatcagttgaagcttattcttttactgaattgcactgcttttccttggatgaatttaaaattgggctgcgcaattcattcaaagcatatatagagaggccatctgaattgcatcttttgtctactatacaggccattgagagatctctagttggtattcatgaaggatgtactgtgatttatgatataacaacaagtaaagatggggggggaatttcatcatttgtaacagctggcattgaatgctttgtcatgattcttgaatttgtttcaggtcggaaaggcttgaagatgattaaaagacactgtcagagttttgtagcttctgttttcaacattattgtacatttacagagtctgcctattttttatgataacttggcatctggaaaagttgccagtacccctgatcctgggtcagccattctcttgggtgttgaagtactggttacagtttcaagaaaacatactctattcccaatggatgtgtggcatgtgggtcacttgttacatatccctgcagcactctttcagaacttctatcagcttagagttactaaagcttctggtccatcagaaacattgatgatttcagatgagcatatttgtgatcaagtaaagagagtggatttctgtcacgtagatcaccagttcttagttaacctatttgaagtgtgttgtgaactattgtataccactattatgcatcgtccaagtgagtgcaaacagtgtgttgctcatcttgaagcttctgttgctgttcttcttaattgcttggagaaagttttagatgatgaatcaatgatgaataaagttttcttttcttcagaagagggagttgcatgtgcttcttctcttcgaagaatttatgaagagataaacaagcaaaaacatatctttggtcgtcaatgttctctgtttttatccaattacatatgggtttattcaggatatggtgatcccaagagaagtggcatcagaagaagagaagtggatgaatctctaagaccgggtgtcgatgctttaatagatgcttgctcacgtgatgatattcaatatcttcatactgtatttggggaaggaccttgcagaaatatcctgttaagtcttgtgggtgatcgcaaacttaccgaatttaaaggaaaagtttga

SEQ ID NO: 3150 - DNA, 903 bp, Glycine Max
atggatgaaactaaaattctcttagagttgaagtccgtttcgtccttatgtgttcatagcttcatcaaccttctatgcgaagaaactatttcttttctctcagtgttctcttcagatcctctgtttcattgcatcgtggcgttttgcaccttggttttcctctatttgccacaccttttcttgaaaataattctatctccagtgcccattctcactgcgattctccttctctctattctccgtctcggtgcaattcaaaggttacaacatgaaagaagggagaatcatgtgaaacacgaagaacaacccatcgtttacgaagaaaacaagggaagtaaatacaagggagagaaacagagtccatgtaccattgaacctgacgaaacaaagtccgtagaacaagtgcaccaatgggtccattcagaaacagaggtcatttccgacatgggttttgaatcaagttctcgttttgttgaatggaacgtgaaagcaccgttggaagtgatatatgaagagtatggtgaaggtgaagaagcaggggatgatgcaaacgagaacgtgggtattatgaggtacccttcgttgtcgcgtttttacccggaatcggattccgatagcgaatcggagagtgagtttccggcgatcggagattgggactcgccggaggaccttgagtttcgctggggtgaagaagaagaagaagatgatggtgatgatgatgatgaagaagaagaagacagagaagggttgattgagatagctctcgatggatgcaagaggaagaggaacttggaatttaactttgatgaagagaatttgattgagatcgatatttctccgtcgaggtacagagaactttccggcgacgacgaggtgttttccggtgagatcagctacaactaa

SEQ ID NO: 3151 - DNA, 1761 bp, Glycine Max
atggatgaaaggaagttgaacattgatgctcctcttatgtcggtgaggcgctcttttggtatatcaccatctttaactgaagcaaataaaaagatattagagaagccacaaacacttccacactacaaatcagacaccgctttggatcaggtaacagaacctgttgcagtgcctttcaattgggagcatatccctggaagaccaaaggattatgatggatcagaacctcaacctcctacacaggcttcaattaccccaaccgccccaactctcccccctggaaaatccacaaatgttgccaaacagtcattggaaaaggaacctaatgtggaagagaatgatgactatgatgatgatagtgatatttattctgatgcccttgaaacactgtcacctacagagcccatgtctatgaactgtagtttgagtggtgtgagtggcttagataatgtggatgaaaataggtgcggaacctcttctactgataaacaagctcatgatttcatgatgagcaggtttttaaatgcagcaaaggctatgactatacaacctcctcaatatgcttcttttagaaagcaacaacctgttctggcagaacaacctagggaatttatcaaattggttcctgagcaaaagaagtcctttgttaatagacatatcactgacattgtaccatatactggtcaatgccaagaggaggaggaggaagaagaagaaagtgacgatgaaactaatgattatgcaaataattcagctaaaggttgcggattgtttccacgcttatgtgttagaaactcattgtgcttactaaatccagtgcctgggacgaaaatggggaatcagtttcccttagagattgacacaatgtcacatgacactgtatatcagtttttcatcaatcacgactttaacacaattataccaatcatgactttttgctgcaggcttgggatgctattaataagagcaaacaagaaagatgtgaggaaaaaatggactagtgaatcaagcaggtataactactcaggtgaattgaagcagctaggtaggctctctccctttcgtcgttcaagagctgcttctgctggagtatctccttttcgaagtaaacctcaacctccctttcctggagcaaagttgcttggtgattccgaacaagctgataataatcattctggcaaattgaaattcccgaatagaggacatgcaagtattcaagaggtgctatcacaaggagccaaaaaaagctatagctttgggagcctttctgttgaaaagacattgtacatagatactgcaagcacagtaaaatcatcatgctctagttcacgttctttaggtagcacaatagtggtaggaaaagacagaaattcccttgtagattcttttcgagatatgaagcacctagaagctttggaggagaatttggattctcaagtcatgttacatctcatggccaaagaagataaagctgaaagattggcagccgatcaagaaattaatcaagaatccatgtccttgcaacttgtgccaagaaaagttgacaatgaatatgttctgcatcctcttgccccaccattgccaaagtcaccttctgagtcctggctttgtcgtgccctgcctctagtctcttctaagaattcattcccacattctaatcaaggtacacattcccaggctaaaagacaaggttttagtagagcatcaaactttactaagtgggaaacaattgtgaaatcttcgaatttgaatcatgatcat

SEQ ID NO: 3152 - DNA, 1284 bp, Glycine Max
atggatgaagagtacgatgtaattgtgttgggcacaggtctcaaggaatgcatcctcagtggccttctctcagttgatggcctcaaggtgttgcacatggatagaaatgactactatggaggggcttctacatctctcaatcttacacagctatggaagcgatttaggggagatgacacaccggcagagaacttgggatccagcagagaatacaatgttgatatgatacctaagtttatgatggccaatggagctttggtccgtgttctgattcacacaaatgttacaaagtatttgaactttaaagctgtagatggaagctttgtgtataacaagggaaagatttacaaagttccagcaacagatgttgaagcactgaagtcaccattaatgggactgtttgagaagcgccgtgctcgaaagttcttcatttatgtccaagattatgaaacaaatgatcccaaatctcacgaaggactagatttaaaccaagttacagcaaggcagctgatttcgaaatatggattggaagatgatacagttgactttattggtcatgccttggcacttcatcgtgatgataattacttggatgagccagccaaggattttgtagacagagttaagatttatgcggagtccctagcacgctttcaaggaggttcaccttacatatatccactctatggactgggagagttgcctcaggcatttgcacgtctgagtgctgtgtatggtggaacttacatgctgaacaaaccagaatgcaaggtggaatttgacgaaaatgggaaagccattggtgtgacttcagaaggagaaacagccaaatgcaagaaaattgtgtgtgatccatcgtatctgtctgataaggttcagaaggttggaaaggttgctcgtgcaatatgtattatgagtcatcctattccagacaccaaagactctcactcagcgcaagtcattctgccacagaagcagcttggtcgcaagtcagatatgtatctcttctgctgctcttatgctcacaatgtagcagccaaaggaaaatatattgcttttgttacaacagaagcagagactgacaaccctgaggtggaattgaagcctggtattgaccttcttggacctgtagatgagatattctatgacacttatgacaggtttgaaccctgcaatgatcatgaagctgatggttgcttcatctctacaagctatgatgctaccacacactttgaaaccacagtaaaagatgtggttgagctgtacagtaagatcactggaaag

SEQ ID NO: 3153 - DNA, 150 bp, Glycine Max
atggatgaagctcaacagaaggaagcaattttgaatgaacatgttatcaggttgaagaaagaaataaaagattgtgagtctgacttgccatctcttcaagatgataagaagaaatgcattgcagaaactatagggtacaaaaaaatgtga

SEQ ID NO: 3154 - DNA, 825 bp, Glycine Max; identical to SEQ ID NO: 344

SEQ ID NO: 3155 - DNA, 894 bp, Glycine Max; identical to SEQ ID NO: 345

SEQ ID NO: 3156 - DNA, 1335 bp, Glycine Max; identical to SEQ ID NO: 346

SEQ ID NO: 3157 - DNA, 1230 bp, Glycine Max; identical to SEQ ID NO: 347

SEQ ID NO: 3158 - DNA, 1713 bp, Glycine Max
atggatgaggatttcgagttcccaagtgctggcaacatggaaatgccagaggaggaagagattgagagtccgattctgaaggttggggaggagaaggagattgggaaaatggggctgaagaagaagttgctaaaggaaggtgaaggttgggacatccctgactgtggagaccaagttgaagtgcattatactggaaccttgcttgatggaaccaaatttgattctagccgtgataggggcacccctttcaagttcaggctaggccaagggcaagtgatcaagggatgggatgaaggtatcaaaaccatgaagaaaggtgagaatgcccttttcacaatacccccagaattggcttatggagagtcaggttctcctcccactattccccccaatgcaactctgcagtttgatgtggagttgctgtcatggacaagtgtgaaggacatttgcaaggatggaggaattttgaagaatataattactgaaggggagaaatgggataatcctaaggatctggatgaagtgtttgttaagtatgaagctaggcttgaagatgggatagtcatttcaaaatctgatggggtggaattcactgtggaagaggggtatttctgtcctgctttggccaaggctgtgaaaaccatgaagaagggagagaaagttctcttgaatgtgaagccacaatatgcatttggtgagagtggaaggccagcctcaggagatgaaggtgccgtacctccaaatgcttctcttcaagtggatcttgagttggtctcgtggaagactgtgtctgacattaccaacgatagaaaggttctcaagaagactttgaaggaaggggagggatatgaacgaccaaatgatggagctgtagttcaagtgaaactgattggcaagctgcaagatggaactgtcttcattaagaagggctacgatgatcaacagccattcgagttcaaaattgatgaagagcaagttactgatggacttgaccaagctgtgaagagcatgaagaaaggggaaattgcattgctgatcatacaacctgaatatgcttttggtccatctggatcctctcaggaattggctaatgttcctcctaattctactgtgtactatgaagttgagctgctttcttttataaaggaaaaggaatcgtgggatctgaatacgcaagagaagattgaggcagctgggaagaaaaaggaagaagggaatgctttatttaaggttggcaaatatgaaagagcttcaaagagatatgaaaaggccataaagtttgttgagtatgattcctccttcagtgatgaggagaaacagaagactaaggcattgaaaatcacatgcaatctcaacaatgcagcctgtaagttgaagctaaaggactacaaacaggcagagaagatgtgcacaaaggttttagagcttgatagtagaaatgtaaaagcactctatcggagggcacaagggtatctccatcttgtggacttggatctagctgagatggatattaagaaagcccttgagattgagccagacaacagggatgtaaagatggagtacaaaattttgaagcagaaagtgagagaatacaacaagaaggacgcacaattttacagcagcatatttgcaaaaatgaataaactagagcaagcaagaacagcaacagcaaagcaggagcctgtgccaatgactattgacagcgaagcttaa

SEQ ID NO: 3159 - DNA, 840 bp, Glycine Max
atggatgatgatgtgttgaacatgcccaattggggttattacgaacccttcagagggggacatcttggccttcagctcatgcctggtatgactgaacgggacacaaagccatttttgcctggtcgggatcctgctatgttaatgggtgctaatggaacttttcaccctcgagattgcgttgtttccgaggcaccaatgccattgaactatgtcagagatagttggataaaccagagagataggttttttcatatgcagcagcccacaaatcctaattatgctgttcttccggagacatcaggagctcctaacttgaaaattatacagccacccgatacgtcaagagatgagaaagtggatagagttgaagaggtcgttgtcaaaaaggaactgggcaagtcgaagaaaaggcacactaagggtgctctgtcgactccaaaagctaagaaacctaggaagccgaaggataatagcaatgttccagttcaacgtgcgaagccaccgaagaagactatggagcttgtaattaacggaattgatatggacatttctgacctaccaattccagtttgttcgtgtactggggctcctcagcagtgttatcgatggggttgcggaggttggcaatcggcttgttgcaccacaaatgtgtcaatatatcctttgccaatgagcatgaaaaggcgtggtgcaaggatagctgggcggaaaatgagccaaggtgcttttaaaaaggttttagagaaacttgcagctgaaggttataactttgctaaccctattgatctgaagactcattgggccagacatggcaccaacaagtttgtcactatcaggtag

SEQ ID NO: 3160 - DNA, 1209 bp, Glycine Max; identical to SEQ ID NO: 348

SEQ ID NO: 3161 - DNA, 1629 bp, Glycine Max; identical to SEQ ID NO: 349

SEQ ID NO: 3162 - DNA, 744 bp, Glycine Max
atggatgcggaggctgtcttgaacctctttgattcttgctggtttgaggttaacattttaaggagaaattctagtcctcacacatcaattacaagttatacagaaaatttagatcatgtgttaaaagaagaaaaagaaccaaagctacccttgatccgaaccagccacaccagatccatgagtgaccaattatccatgacaacaacaagcttcaaccaagattctctttcacctgactcagtgcttcttctccatccaaagctccaaaccattctctcaggaaaagaagccactgactcagaacctgatgagaacccaagaacgcaggttaggcctcatcctgaggtgttgtgtcctaagaagaacaaaaaaatctcaagcagtagaactaggaagaggagggagagcaagagtttgtcagaccttgaatttgaggagcttaaagggttcatggatctgggttttgttttctcagaggaggataaagactcaagcttggcttcaattattcctgggttgcaaaggctacggaagaaggaagaggaagaagaagaaaatgaagattgtgatgagataagtgttccaaggccttacctttctgaagcatgggaggttcaggaatatgataggagaaaaaaagagaactctttggtgaattggaaaatgcctgctatcaacaatgaaactgacatgaaagaaagtcttagatggtgggctcatactgttgcttccactgtcagatga

SEQ ID NO: 3163 - DNA, 387 bp, Glycine Max; identical to SEQ ID NO: 350

SEQ ID NO: 3164 - DNA, 399 bp, Glycine Max; identical to SEQ ID NO: 351

SEQ ID NO: 3165 - DNA, 984 bp, Glycine Max; identical to SEQ ID NO: 352

SEQ ID NO: 3166 - DNA, 1125 bp, Glycine Max; identical to SEQ ID NO: 353

SEQ ID NO: 3167 - DNA, 888 bp, Glycine Max; identical to SEQ ID NO: 354

SEQ ID NO: 3168 - DNA, 705 bp, Glycine Max; identical to SEQ ID NO: 355

SEQ ID NO: 3169 - DNA, 606 bp, Glycine Max
atggattacagtgctggttcgagtctgtttccgttgcaccgttgcaaaaccattcacctggtgaggcacgcgcaggggattcacaatgtggagggtgacaaaaactacaaagcctacatgaaccccgattacttcgatgctcatctcactcccttgggatggcaacaggttgacaatttgcgtaagcatgttcgcgactctggccttatcaacaccattgatctagtcattgcatctcctttgatgaggactctacaaacaactgttggggtatttggaggtgagggctacacagataaaacagacgtccttcctcttatggttgcaaatgcaggaaatagctaccgtgctgcaatttcaagtctaaattccccaccaattgttactgttgaactttgtcgtgaacatttgggagttcatccctgtgacagaagaagaagtgttagcgagtatcaatttctttttcccgctgttgatttttcactgttagatagtgatgaggatacctggtggaaggccaatgttagagagacaaaggaagaacttgcagctagggggatgaagttccttaactggtatgagtttgttataattagaaacttctaa

SEQ ID NO: 3170 - DNA, 840 bp, Glycine Max
atggattacagtgctggttcgagtctgtttccgttgcaccgttgcaaaaccattcacctggtgaggcacgcgcaggggattcacaatgtggagggtgacaaaaactacaaagcctacatgaaccccgattacttcgatgctcatctcactcccttgggatggcaacaggttgacaatttgcgtaagcatgttcgcgactctggccttatcaacaccattgatctagtcattgcatctcctttgatgaggactctacaaacaactgttggggtatttggaggtgagggctacacagataaaacagacgtccttcctcttatggttgcaaatgcaggaaatagctaccgtgctgcaatttcaagtctaaattccccaccaattgttactgttgaactttgtcgtgaacatttgggagttcatccctgtgacagaagaagaagtgttagcgagtatcaatttctttttcccgctgttgatttttcactgttagatagtgatgaggatacctggtggaaggccaatgttagagagacaaaggaagaacttgcagctagggggatgaagttccttaactggttgtggacacgaaaagagaaggagatagcaattgtgacacatagtggattcttgtttcatactctgaatgcctttggaagtgattgccaccccttggtaaagaaagaaatatccaagcactttgctaattgtgaacttcgctccatggtcattgtggatagaggtatgataggattggaacaatcaaccactaactatccaggcaagataccttcagggctggacctccctagtgatgttgcagatgagaagtctgagaaataa

SEQ ID NO: 3171 - DNA, 1809 bp, Glycine Max
atggattacgaaaggatccaaaagcctcagggtggtgggggattttcaccgggaaaattgaggagcatgctactgggtgtggagaagaagaggaaagaagaggaagagcttgattctactttcaccacgagatctcagaattcagacatggatgaatctggtggtagtagttccgatcattgcaaagatgtagatgttgtgagtgtccttcctgaatattcaacttctgctatagttcgcactagtagcgtagaggcagttggtggtgatcgttttgtgaaggctaatgcaggagtgaattcaaggagtagaatcttggaagacccttcttcagattatgatagtgggcacgataatatgagcatgtcctcgtcaatgtttgaatttcaaaaggccgagcgtgccccacagagggttcccgtggggccattctcaaaaccagcaccatctaaatgggatgatgcacagaagtggatagcaagtccaacttcaaacaggccaaagacagtgcagagccaggggcaaggtgggcaaagtgggcatgtaggaccgcgaaaggttggtagtcttggttatggaagccggcaatcttcaatgaaggttgttgttgaagttccagatcaaaaagaaattgctttagatgaaccagataccaagcaaattgatacagatcagactaagatggaaactggaggacagaaatttgtgagttgggaggctgatccctatgcaattgcaagttcttgtgggtctttatgtttatttggggctggttattcaacctgggcgtaccaccaattgtgtggatcaactagcgtggggttgttccaacttaaaccagatgtctctggttcaagtcctgggtatgcaaatgcgttaaatacttggagggagagttttgccgcatatagtagtcctatctggctcaaacagcctccaatggaggatacctgtgatctagaccaaaaaaacctgggccttaagttacggtttacttgtctcagccagcacaattcatctcttgcaatccaaaatgaaacaacatttgttcctcccccttcaacagctcggtctgtatcaatgagagatatgggtaccgaaatgacccctattgctagccaggagccatcaagaacaggtaccccagtgagggcaacaacaccgatgcgcagccctaattcttcccggccttctactccccccagagcctcccctgcatctactttaactgatctgcatagtgacaatctgaatctcaacatgaatgagttgtccgaaaaggagctacaaatgaaaaccaggcgagaaataatggttctcgggacacaactaggtaaaatgagcattgctgcctgggctagcaaagaagaggaggataaggatgcatccacttccttgaaaacaaaaacagaaccacctaaaagtgtcgttgtagcacgtgcagcggcatgggaggaggctgagaaggccaagtatatggccaggtttaggcgtgaggagatgaaaattcaagcatgggaaaatcatcagaaagcaaaaacagaagccaagatgaaaaaaattgaggtagaagttgaaagaatacgaggtaaggcgcatgataagctaatgaacaaattagcagctgcaaggcataaagccgaggaaaagcgagcagcagcagaagccaatagaaatcatcaagctgcaaaaactgaagagcaagcagagtatatacgaagaactggtcatgtcccttcctcatatttatcattttcttgctgcaattggtatgcaatgccttttgctgcttacacccaagcatgttaa

SEQ ID NO: 3172 - DNA, 1578 bp, Glycine Max
atggattatccgtacattctaggagggatcatggcttgtagttttgcatttttgtatgttgtgtacagttttggagcaaagaaggtcacagattcaagttcaatacatgtaaagagtaatgagtgtgcaaagacatcatcagaaggtggaatatgttcttcagatgaggatgcaggaagtgctgacatcatcattgtgggtgctggggttgctggtgcagctcttgcttacactcttggaaaggatggacggcgagtgcatgtaattgaaagggatttgagtgaacctgacaggatcgtgggtgaattgctacaacctgggggctatctgaggttaattgagttgggccttcaggattgtgtggatgaaattgattcacagcaagtctttggctatgctctgtatatggatggcaaaaataccaagctgtcttatcctttggaaaaattcagctctgatatttctgggagaagctttcacaatggccgtttcatacagagaatgcgagaaaaggcttcgtctcttccaaatgtaaaattagaacaaggaactgtcacatctctacttgaagagaaaggaaccatcactggggtgcactacaaaatcaaaagtggacaagagttcacagcaaaggctcccctcaccatagtatgtgatggttgtttttccaacttgaggcgttctctttgcaatcctaaggttgacgttccctctcattttgttggtctggtcttggagaattgtaatcttccatatgcaaatcatggtcacgtcatcttaggtgatccttcacccgttttgttttatcccatcagtagcactgagattcgctgtttggttgatgtgcccggccaaaaattaccttccctaggtggtggtgaaatggcctgttatttgaaaactgtggtggctcctcaggttcctccagagctgtatgattcttttatagcagctattgacaaaggaaacataagaaccatgccaaatagaagcatgcctgcctcaccttatcccacaccaggtgcacttctaatgggagacgccttcaatatgcgtcaccctttaactggaggaggaatgactgtggctttatctgacattgttgtgctaagggatttacttaaacctcttcatgatctgcatgatgcttctgctctttgcagataccttgaatcattctacaccctacgcaagccagtggcatctacaataaacacactagctggggcattgtacaaggtcttttgtgcatctcctgatccagctagaaaggaaatgcgccaagcatgtttcgattacttgagccttggaggtgttttctcagatggaccaatagctctactctctggtctaaatcctcgtccattgagtttggttctccatttcttcgcagtcgctatatacggtgttggccgcctgctcataccatttccttctccaaaacggatgtggattggagctagattgatttcaggtgcatcaggcatcattttccccattattaaggctgaaggagtgagacaaatgttcttcccagcaactgtgccagcatattacagaacccctcctgtccattga

SEQ ID NO: 3173 - DNA, 1542 bp, Glycine Max
atggattatccgtacattctaggagggatcatggcttgtagttttgcatttttgtatgttgtgtacagttttggagcaaagaaggtcacagattcaagttcaatacatgtaaagagtaatgagtgtgcaaagacatcatcagaaggtggaatatgttcttcagatgaggatgcaggaagtgctgacatcatcattgtgggtgctggggttgctggtgcagctcttgcttacactcttggaaaggatggacggcgagtgcatgtaattgaaagggatttgagtgaacctgacaggatcgtgggtgaattgctacaacctgggggctatctgaggttaattgagttgggccttcaggattgtgtggatgaaattgattcacagcaagtctttggctatgctctgtatatggatggcaaaaataccaagctgtcttatcctttggaaaaattcagctctgatatttctgggagaagctttcacaatggccgtttcatacagagaatgcgagaaaaggcttcgtctcttccaaatgtaaaattagaacaaggaactgtcacatctctacttgaagagaaaggaaccatcactggggtgcactacaaaatcaaaagtggacaagagttcacagcaaaggctcccctcaccatagtatgtgatggttgtttttccaacttgaggcgttctctttgcaatcctaaggttgacgttccctctcattttgttggtctggtcttggagaattgtaatcttccatatgcaaatcatggtcacgtcatcttaggtgatccttcacccgttttgttttatcccatcagtagcactgagattcgctgtttggttgatgtgcccggccaaaaattaccttccctaggtggtggtgaaatggcctgttatttgaaaactgtggtggctcctcaggttcctccagagctgtatgattcttttatagcagctattgacaaaggaaacataagaaccatgccaaatagaagcatgcctgcctcaccttatcccacaccaggtgcacttctaatgggagacgccttcaatatgcgtcaccctttaactggaggaggaatgactgtggctttatctgacattgttgtgctaagggatttacttaaacctcttcatgatctgcatgatgcttctgctctttgcagataccttgaatcattctacaccctacgcaagccagtggcatctacaataaacacactagctggggcattgtacaaggtcttttgtgcatctcctgatccagctagaaaggaaatgcgccaagcatgtttcgattacttgagccttggaggtgttttctcagatggaccaatagctctactctctggtctaaatcctcgtccattgagtttggttctccatttcttcgcagtcgctatatacggtgttggccgcctgctcataccatttccttctccaaaacggatgtggattggagctagattgatttcagtgagtacttctcattttcctttttgctcaaacaacatacagaatatttcacacattacttactgctaa

SEQ ID NO: 3174 - DNA, 867 bp, Glycine Max; identical to SEQ ID NO: 356

SEQ ID NO: 3175 - DNA, 630 bp, Glycine Max
atggattcgagttcggggcatcaagaattcgattatttgtttaagttgttgatgattggagactctggggttggcaagagtagtcttcttctcagtttcacctccgatgcttttgaagatctctcccccactatcggtgttgattttaaggtcaaatatgtgatgatggggggtaaaaagctgaagcttgcaatttgggatactgctggtcaggagagattcagaacactgacaagttcttactacagaggggcacaaggaatcatcatggtttatgatgtaacccggcgagatacatttacaaatctttctgaaatatgggcaaaggaaatagacctttattcaactaatcaagattgcatcaagatgcttgttggaaacaaactagataaggacggtgatagagttgtgacaaagaaagagggaatagactttgccagggaatacggttgcctatttattgaatgcagtgctaaaactcgagttaatgttcagcaatgctttgaagagcttgttttgaagattctggatacacctagcctcatagccgagggctcaaagggtgttaaaaagaacattttcaaggacaggccaccccagtctgatgcatccgcaagtagttgttgctga

SEQ ID NO: 3176 - DNA, 945 bp, Glycine Max; identical to SEQ ID NO: 357

SEQ ID NO: 3177 - DNA, 972 bp, Glycine Max; identical to SEQ ID NO: 358

SEQ ID NO: 3178 - DNA, 936 bp, Glycine Max
atggattcggtgccttcgaattcgcatggaaacctcgatgagcagatttctcagctcatgcagtgcaaacccttgtccgagcaagaggtaagggtcttgtgtgataaggcaaaagagattttgatggaagagagcaatgtacagcctgtgaaaagtcctgttacaatttgtggtgatattcatgggcaattccatgatcttgcagagctttttcgcattggagggaagtgtccagatacaaattacttgtttatgggagattatgttgatcgtggctattattctgtcgaaactgttacgcttttggttgcccttaaagtgcgttatcgtcagcgtattactattctgaggggaaatcatgaaagtcgccagattactcaagtttatgggttttatgatgagtgcctgcggaagtatggtagtgctaatgtttggaagatctttaccgatttgtttgactactttccgttgacagcattggttgaatctgaaatattttgtcttcatggtgggttgtcgccatctattgaaaccctggataacatacgtaattttgatcgcgtacaagaagttcctcatgagggacccatgtgtgatcttctatggtctgatccagatgatcgttgtggttggggcatctctcctagaggtgctggatatacctttggccaggacatatctgagcaatttaaccataccaataacttgaagctgattgctagagctcaccagctggttatggaaggatataactggggacatgatcaaaaggtggttactatatttagtgcacctaactattgttatcgttgtgggaatatggcatcaattcttgaggttgatgactgcaaaggacacacattcattcagtttgagccagctccaaggaggggagagccagatgtaaccaggagaacgcctgattacttcctatga

SEQ ID NO: 3179 - DNA, 771 bp, Glycine Max
atggattcggtgccttcgaattcgcatggaaacctcgatgagcagatttctcagctcatgcagtgcaaacccttgtccgagcaagaggtaagggtcttgtgtgataaggcaaaagagattttgatggaagagagcaatgtacagcctgtgaaaagtcctgttacaatttgtggtgatattcatgggcaattccatgatcttgcagagctttttcgcattggagggaagtgtccagatacaaattacttgtttatgggagattatgttgatcgtggctattattctgtcgaaactgttacgcttttggttgcccttaaagtgcgttatcgtcagcgtattactattctgaggggaaatcatgaaagtcgccagattactcaagtttatgggttttatgatgagtgcctgcggaagtatggtagtgctaatgtttggaagatctttaccgatttgtttgactactttccgttgacagcattggttgaatctgaaatattttgtcttcatggtgggttgtcgccatctattgaaaccctggataacatacgtaattttgatcgcgtacaagaagttcctcatgagggacccatgtgtgatcttctatggtctgatccagatgatcgttgtggttggggcatctctcctagaggtgctggatatacctttggccaggtagtcctgtttgttatgtatcaagcttgtattgttttcatctgtcaccattacttttttttattgcttatgcaacttgcttttgtaggacatatctga

SEQ ID NO: 3180 - DNA, 1263 bp, Glycine Max; identical to SEQ ID NO: 359

SEQ ID NO: 3181 - DNA, 2814 bp, Glycine Max
atggattctgcgttctccatcaacaccaccgcgcaagtggcgctcttcagagcgctccacggtcatctccaccgagctcctcaacgcgccttgctccgccgcaacctaaaatgcctcgttacttcctataacagcagcagcaactgctgccgcattccgtgctctttcggctccgtgccgtcgccgtcctcgcttcgatccttccgcggactgctcccgcgaacgccgcgctgcatttcgagctccgcggcttcctttgcttctcctgccggcggtggaaatggcggcgctggaaccggcgacggtgacggaggtggcggttctggcggtgagtctggagatgctaatctcaaactggtaggagacgcgtctcaggagctttccgcactttcgcctgatgttatcattctcgatgtttcgggaatggtatgtgggggatgtgcggcgactgtgaaaaggatactggaaaatcaaccacaagtgtcatctgctagtgtaaatttaacaacagagacagcaatagtttggcctgtatctgaagcaaaaaatgcaccaaattggcaaaagcaattaggggaggcacttgctgagcatttaactagttgtggctataattctagccttcgagactcaacaagagacaacttcctccaaatttttgaaaggaagatggaggaaagacatagacaattaagagaaagtggtcgtgagctagctgtttcttgggctctatgcgctgtctgccttgttggccatttctctcatttctttgcagcaaaggcaccatggatccatgtatttcattccattgggtttcatctttcgttgtctttgtttacgttgcttggtcctggccgccaacttatccttgatggcttaaaaagccttcttaaaaggacgccaaacatgaacaccttagttggtctcggggctttatcatcatttacagtcagttcatttgctgccttgctgccaaaattgggttggaaggccttctttgaggaaccaattatgctaattgcatttgtcttgttaggaaggaatctcgaacagagagctaagattaaagcagccagtgatatgacaggacttcttagtttattgccaccaaaagctcgccttcttttgaacaatggggaaacagaggttggctcggttgttgaagttccttctgacagtctttctgttggagaccaaattattgtattacctggagatcgtattccagctgatggagttgtgagatctggtagaagcactgtagacgaatcaagttttactggtgaaccactgcctgtaacaaaagtacctgggagtgaggtagcagctgggagtataaatcttaatggaactcttacaatggaagtgcagagaccaggtagtgagactgctatggcaaacattgttcgtctagttgaagaggcacaaagtagggaagctcctgtgcagcggttggctgacaaggtggctggacacttcacttatggagtgatggcaacctctgctgccacattcacattctggagtctgtatggcacacacattttacctcctgctttatatcaaggacgtgcagtttcactggctttgcagcttgcttgcagtgttctggttgttgcttgtccatgtgcacttgggttagccacacctactgcagtgctggttggaacatctttgggagctaagagaggattacttcttcgtggtggaaacattctagagaagtttgccatggtagacactgttgtgtttgacaaaacagggaccctcacggttggtagacctgttgtgacaaacattgtcattcctatttgcataaaaaatgcaatttcaagccaaactgaagaaaatgctttgtctgatgttgaagttctaaggttagcagctgcagtagaaacaaattcagtacatccagttggtaaagcgattgtggatgctgctcaggctgctaattgtcataatgctaaggtaaaagatggaacattcctggaagaacctggatctggtgctgtggcaacaatttatgacaaaaaggtttctgttgggacattagaatggattaccaggcatggagttattaacagtatacatcaagaagtggagaagagtaataatcaatcctttgtctatgttggagttgatgatactttagctggcctaatttattttgaagatgagataagggaagacgcaagagacgttgttgatagattgtcaaagcaaaatataggtgtatacatgctatcaggagacaagaggaatgctgctgagcatgttgcgtcccttgttggaattcccaaagagaaggtgctatctgaagtaaaaccagatgagaaaaagaagttcataaatgaactacagaaagataacaacattgtagcaatggttggtgatggaattaacgatgcagctgccctggcttcttcacatgttggtattgcattaggtggaggtgtcggggctgctagtgaggtgtcttctattgtattaatgcgcaaccagctctcacagatagttgatgccttggagcttagcagactgaccatgaatactataaaacaaaatctttggtgggctttcatatacaacattgtaggaattccaattgcagctggagtgttatttcccataaatgggactgtgctaactccatcaattgcaggggcactcatggggttgagctccattggcgtaatgactaactcgttacttttgagattcaaattttcgtcaaagcagaagcaaatacatagcatatcgccaaagaccaaaatccatgtggcccaaaatcagaaaacaaaccacccttattag

SEQ ID NO: 3182 - DNA, 2553 bp, Glycine Max
atggattctgcgttctccatcaacaccaccgcgcaagtggcgctcttcagagcgctccacggtcatctccaccgagctcctcaacgcgccttgctccgccgcaacctaaaatgcctcgttacttcctataacagcagcagcaactgctgccgcattccgtgctctttcggctccgtgccgtcgccgtcctcgcttcgatccttccgcggactgctcccgcgaacgccgcgctgcatttcgagctccgcggcttcctttgcttctcctgccggcggtggaaatggcggcgctggaaccggcgacggtgacggaggtggcggttctggcggtgagtctggagatgctaatctcaaactggtaggagacgcgtctcaggagctttccgcactttcgcctgatgttatcattctcgatgtttcgggaatggtatgtgggggatgtgcggcgactgtgaaaaggatactggaaaatcaaccacaagtgtcatctgctagtgtaaatttaacaacagagacagcaatagtttggcctgtatctgaagcaaaaaatgcaccaaattggcaaaagcaattaggggaggcacttgctgagcatttaactagttgtggctataattctagccttcgagactcaacaagagacaacttcctccaaatttttgaaaggaagatggaggaaagacatagacaattaagagaaagtggtcgtgagctagctgtttcttgggctctatgcgctgtctgccttgttggccatttctctcatttctttgcagcaaaggcaccatggatccatgtatttcattccattgggtttcatctttcgttgtctttgtttacgttgcttggtcctggccgccaacttatccttgatggcttaaaaagccttcttaaaaggacgccaaacatgaacaccttagttggtctcggggctttatcatcatttacagtcagttcatttgctgccttgctgccaaaattgggttggaaggccttctttgaggaaccaattatgctaattgcatttgtcttgttaggaaggaatctcgaacagagagctaagattaaagcagccagtgatatgacaggacttcttagtttattgccaccaaaagctcgccttcttttgaacaatggggaaacagaggttggctcggttgttgaagttccttctgacagtctttctgttggagaccaaattattgtattacctggagatcgtattccagctgatggagttgtgagatctggtagaagcactgtagacgaatcaagttttactggtgaaccactgcctgtaacaaaagtacctgggagtgaggtagcagctgggagtataaatcttaatggaactcttacaatggaagtgcagagaccaggtagtgagactgctatggcaaacattgttcgtctagttgaagaggcacaaagtagggaagctcctgtgcagcggttggctgacaaggtggctggacacttcacttatggagtgatggcaacctctgctgccacattcacattctggagtctgtatggcacacacattttacctcctgctttatatcaaggacgtgcagtttcactggctttgcagcttgcttgcagtgttctggttgttgcttgtccatgtgcacttgggttagccacacctactgcagtgctggttggaacatctttgggagctaagagaggattacttcttcgtggtggaaacattctagagaagtttgccatggtagacactgttgtgtttgacaaaacagggaccctcacggttggtagacctgttgtgacaaacattgtcattcctatttgcataaaaaatgcaatttcaagccaaactgaagaaaatgctttgtctgatgttgaagttctaaggttagcagctgcagtagaaacaaattcagtacatccagttggtaaagcgattgtggatgctgctcaggctgctaattgtcataatgctaaggtaaaagatggaacattcctggaagaacctggatctggtgctgtggcaacaatttatgacaaaaaggtttctgttgggacattagaatggattaccaggcatggagttattaacagtatacatcaagaagtggagaagagtaataatcaatcctttgtctatgttggagttgatgatactttagctggcctaatttattttgaagatgagataagggaagacgcaagagacgttgttgatagattgtcaaagcaaaatataggtgtatacatgctatcaggagacaagaggaatgctgctgagcatgttgcgtcccttgttggaattcccaaagagaaggtgctatctgaagtaaaaccagatgagaaaaagaagttcataaatgaactacagaaagataacaacattgtagcaatggttggtgatggaattaacgatgcagctgccctggcttcttcacatgttggtattgcattaggtggaggtgtcggggctgctagtgaggtgtcttctattgtattaatgcgcaaccagctctcacaggtcattattatttaccttaattttttcctcaaatttacttaa

SEQ ID NO: 3183 - DNA, 3447 bp, Glycine Max; identical to SEQ ID NO: 360

SEQ ID NO: 3184 - DNA, 282 bp, Glycine Max
atggattggcaagggcaaaagctagcggagcaactgatgcagataatgctgcttgcatttgctgtgattgcatttgttggtggatatgtcatggcttctttccaaatgatgattctcatatatgctgggggtgtggttttcaccaccttgctcactgtccccaattggccccttttcaatcgccatccacttacgtggttggatccaactgaggtggaaaagcatcccaagccacaaccatctgtcaatgtaactcaaaagaagaaacccgttaagaagtag

SEQ ID NO: 3185 - DNA, 2112 bp, Glycine Max; identical to SEQ ID NO: 361

SEQ ID NO: 3186 - DNA, 2502 bp, Glycine Max; identical to SEQ ID NO: 362

SEQ ID NO: 3187 - DNA, 849 bp, Glycine Max; identical to SEQ ID NO: 363

SEQ ID NO: 3188 - DNA, 852 bp, Glycine Max; identical to SEQ ID NO: 364

SEQ ID NO: 3189 - DNA, 1380 bp, Glycine Max
atggatttccaagtggtcgttctcggcggtggcctttccaagaagctcctccctctcgtttctcaggagcttccgaacgcgttgcttccggtggcgaatcgccccgttctctcctacgttctcgagtacttggagcttagcaacctcaaagatctcattgtggtggttgaaggcgaagaagcggttcttcatgttggggcttggatttcgggggcttatgctgatcgcctccacgttgaggttgctgcagttcctgaggatgtggggacagcgggtgcaattcgggccatttcgcatcacctaacagctaaagacattttggttgtcagtggtgatcttgttaccgatgttccacttggtgctgttgcagctactcatagacggcatgatgcagttgtcactgctatgctttgctctgctcctgtaagtggaccttcggagtcagtatcctctggtgggaaagacaaaatcaagaaacctggccgttatgatttgatagggctggaccccacaaaacagtttttagttcacatagcaactggagcagaagttgaaaaagatcttcgaattcagaagagcatgctccctgcagttggccagatagaaataagagctgatctaatggacgcccacttgtatgcattcaaaagatcagttctacaagaagttctagatcagaagagtgcatttcatagcttaaagcatgatgtattgccatatctagtccggagccaactgaaatcagaagtattattaaatggtatgccacaagcagaagaaaacggaactgaaaaggttatttctcaaagcaatcaacaaatgctatctcaaatactcgctaatgcatctgaaccaatctttcatctacgaaatgcactgggtcctcatggttctacttctgatcgaagaacccacaaatgttgtgtgtatattgctggaagcagcaagtactgtgctcgcttaaattctatacaagcatacagtgacataaaccgagatgtgacaggagaggctagtcacttatcagggtattccttctctgctcaaaacaacattatccatccttctgcagagcttggggcaaaaacaactgttggaccacattgtatactgggggaaggttcacagatgggtgacaaatgcagtgtgaaacgatctgtcattggccgtcattgtcggataggtcccaatgttaaggttgtcaattcagtagttatgaatcatgttactattggagaatcttgttcaatccaaggttctattatctgcagcaatgtacagctccaagaacgtgccatcctaaaagattgccaagttggagcaggttttgtggtcactgctggtagtgagtgcaagggggaggtcttggctaagaaatga

SEQ ID NO: 3190 - DNA, 780 bp, Glycine Max
atggatttccctcccgccttcaatctcctcaccgaattcggttgcggcttcgtccttctccgctccctctcgcgcattttcaatcttctaggcctctttctcatgctcaccttctgcttcaagcttctgcgcttcggctggaacaccaagggctccattcgcttcctctgcgactccggcggcatccccaaactccgcttctgcctcgataacaccaaacctttgaaaaaaccgcgccacccaacttcgagctcttccttccggaggcggcccaatgagtccggggagagaggcaacgcggtttcggatgatgggtcggagggaaaggtagagaacgagagagagggttgcaatgaggacgaggtgttcgacgtaatgacgctgagaagaatcgtgaggatggagcggcagaaggccaatgcggcgtgcgcagacctcgagaaggagaggacggcggcttcctcatctgcggaggaggcgatggcgatgatcctgcggctgcagagcgagaagagcgcggcagagattcaggcaacgcagttccggcggatggcggagcagaagctggattacgaccaggaggtgattgagtcgttgcagtggacgatcacgcagcacgagtttcagaagtgtgaggtggaggatcggatagggatgtatgatgaaatagagcgaattgaagatgaagtgagtaggtgttttatgtgtgataatgataatgatgatcctgatggtaattcagtaggtagctctcccgaaaccgaatcacagaccttgtaa

SEQ ID NO: 3191 - DNA, 1920 bp, Glycine Max
atggatttgaacatgaaagctttactgtctcctcatgatgctgaacttaggaaggatgacaactttggtgatactacattatgcttgaatggcattggctttggagaaacaagtaagactagttatacatgtactgagagcaatcttgggatgaagttttccaatgtttctgatgatggctgcagattggttctgggattgggcccaacccctatggcatatggcgatgactacaacaatttggggttgaatatgaagaaaaagtcagccaacctttttactcagcatgtgccatctgaatgtgaatcaatccttcaacttggtctttcgggtgtaacaaatgaggcatcaagtgtgcttgactgctcaggttcaactgagactgatgtgaatatgtcatgtttctcaagccaaacttcttcagaaaattattattcaaggattcctgttgttgatgagggttctacctcagcaaagaaatcaggtggctatatgccatcacttcttttagctccaagaatggatagcgctgaaagttcagtgcagacacaagaatttattgttggaagtaaacctcaaccgtgcccagaaccatccaatggtgtagattactcacttggcactgtatctgggccccaggatacagggataactccagagaaccgaacaagcaaccctaagagatgtagattttttggctgtacgaagggagctcgaggtgcttcggggctttgtattggacatggtggtggacagagatgtcagaaacctggatgcaacaaaggtgctgagagccgaactgcttattgcaaggcccatggtggagggaagaggtgccaacacttgggatgtactaaaagtgctgaggggaagacggattattgcattgctcatggcggtggtaggcgatgtgggtatccaggtgggtgcaacaaagctgcacggggtaagtcaggactttgcattagacatggagggggtaagaggtgtagaatagaaggttgcactcggagtgctgaagggcaggctgggttgtgcatctctcatggaggtggacgccgttgtcagtaccaagaatgtaataagggtgcacaagggagcactatgtattgcaaagcacatggtggtgggaaacgatgctcatttgcagggtgtaccaaaggtgctgaaggaagcaccccattgtgtaaggcacatggtggggggaagcgctgccttttcaatggaggtggcatttgcccaaaaagtgtgcatggaggcactaacttctgtgttgctcatggtggtggaaagaggtgtgctgttgcaggttgcaccaagagtgcacgtggccgtactgactgttgtgtcaggcatggtggggggaagcgatgcaagtatgaaggctgtgggaagagtgctcaagggagcacagatttctgcaaggcacatggtggaggaaagcgatgtagttggggagatggaaagtgtgagaaatttgcaaggggaaagagtggactctgtgctgctcacagcagcttggtgcaggagcgggaaatgaacaagggcggtctgattgcgccaggacttttccgtggtcttgtaccttctgcttccactgcctgtagcagttttgagaacaattcttcctcaggtgtcagtgttctgtccgactcctacgattccatggaaactccagcaaaaagacagcacctgatacccaaggaggtgctagttccgctctcgatgaaatcaccatcttattcaagcttcttggctgccaagaagtcggaccaagatagaaactgccaaagcttggccgcaggcggcagtggtgctcagaaaggcattgactttaatctcccggagggcagggtccacggcggcgacctcatgttgtattttggagggaatctcaaaaatgcacttgacggcatctga

SEQ ID NO: 3192 - DNA, 2349 bp, Glycine Max
atggatttgagcgaggaagttagggcagctcacaagcgagaattctccgatttcttagatcaagatgttggaaagggcatatacatggacgaaatcaaaaccctaatcaaccacaagcgtcaccgcctcatcgtcaacatctccgatctccacaacttccgcgacttgggtaacaggattctgaggagtccaagtgagtacatgcagccgttctgtgacgcggtcacggaggctactcgtgctatcgatcccaagtatttgaaggaaggggaacaagtgcttgttggatttgaaggcccttttgtttctcgccgtgtcacgcccagggaacttctctctgaattcataggttccatggtctgtattgagggcattgtcactaaatgttctcttgtaaggccgaaggttgttaaaagtgttcatttttgccccaccacgggaagcttcacttctcgcgaatatcgtgatattacatctaatttgggattgcccacaggatctgtttaccctacaagggatgaaaatggcaacttactcgtgactgagtttggattgtgcaaatacaaagatcatcaaactttgtccattcaagaagttcctgagaattctgctcctggtcaactcccaagaacagtggatgtcattgcagaagacgatcttgttgattcttgcaagcctggagatcgagtggcaattgtggggatatataaggctcttgcagggaaaagcaaaggcagtgtgaatggagtattcaggactgttctcatagccaacaatgtttctcttctcaacaaagaggctaatgcaccaatctacagtgctgaagatgtcaaaaacattaaagagatagctgcaagagatgatgcatttgatctgctaagtaattcacttgcaccttctatatatgggcattcttggataaagaaagcagtggttttgttgatgcttagtggggtggagaagaacttaaagaatggcactcacttgcgaggtgacatcaacatgatgatggttggcgatccctctgttgccaagtctcaactcttgagagcaattatgaacattgctcccttggccatatcaactacaggccggggttcttctggggttggtttgacagccgcagttacttcagatcaagaaacaggggaaagaaggcttgaagctggggcaatggtgcttgctgacagaggtgttgtctgcattgatgaatttgacaagatgaatgatcaagatcgtgttgctatacatgaagttatggagcagcagaccgtgactattgccaaagctggtatccatgcttcactgaatgcccgatgcagtgtggttgcagctgcaaatcccatatatggaacttatgatcgttcattgactccaaccaaaaatatcggactcccagactccttgctttctcgatttgatctactttttattgtgttggatcaaatggatcctgatattgatcgtcgaatatcagagcatgtccttcgtatgcatcgatttcgttctgctgttgatggaggtgaggcagcacttgatgggagctcaagatatggaagagaagatgaagctgatatggactcatctgtctttgtcaaatataacagaatgttacatgggaagaaaactggaagaggtcaaaaacgtgatacgcttacaattaagtttcttaaaaaatttatccactatgctaagcataggattcaacctgaactgactgatgaggcatctgagaacattgccacggcctatgctgagctcagaaattcaagttcaaatgcaaagactggaggaacacttcccataactgccagaactttagaaaccataatacgtctctcaacagctcatgccaaattgaagttgagcagagaggtttctaagtctgatgttgaagcagctttgaaggttctaaattttgcaatatatcacaaagaactgacagaaatggaggagcgtgagcaagagagggagagagagctggacaggaagcgcaaggctgatcatgatgaaaatgatggtcctgatcgtggtcctaaagatagaagaggtcctaaagataaaagagggccaacatcaacggatgccatggaagtagatgataactcagcaactcatgctgctgtcggacccacccctgaaagaattgaagaatttaattctctatttaatcagcatatgcatgccaaccgcctggaacaaataactattgcaaacttagggaatgttatcaacagagggcaagatccaccaccttacagtgctgcagatatactactcctattagagaggttgcaagacgacaatagagtcatgataactgatggagtggtgcatatgatatcataa

SEQ ID NO: 3193 - DNA, 2349 bp, Glycine Max; identical to SEQ ID NO: 3192

SEQ ID NO: 3194 - DNA, 189 bp, Glycine Max; identical to SEQ ID NO: 365

SEQ ID NO: 3195 - DNA, 861 bp, Glycine Max
atggatttggaaccctgggaagcacttgacgtggatgacaccaatctctccgccttcctccgcccttgcaactctaattccgattcctcttccctcattcccggtcctgccggcgccgtccaggccgtgatgaggaaccggcgccaccatgaccccctctccactcaagaatttctaaagcgagttgagcgccaaagtgaccgcgatttcaacaccaatccctggctctgtgccctccaattcgtgcacttgcagggtggtgatgatgacgtggcacacggcactccgttgagctcaatccagaacaacgccgagactgagagagtaccgttgatcgtggcccttgtcaaatcctccactcccaatggtttcggagacatcacggttaacctcaaggatcctacagccactcttactgccactgtccatcgcaaagttttttcacatccagatcttaggaaggaaattttaactgttggttcagttttaattctccaaaaggttgctgtgttctctcccaatcgcaatacccgttatctcaacataacattgcacaacattgtcaagtataaatcaataaaaaattatactagttatgtcttccaagttacttgttgtaaaaaaagacatgaaaggttattgacaccaggcagtacattctctctgccactggaaagaaccgaaggaatcatgtctaatctcagtgaggtggaagatcaacccaacccccctaaattggatgaaggaggagacattctagcacggattgctcaaggcaatagttctgcaacaaactcaattcctacatctcatggtgaaaaaactgggatggagaatcactttgaaagacagacgcagatg

SEQ ID NO: 3196 - DNA, 1290 bp, Glycine Max
atggatttgtattttcctttggcaatacttgtgctgatattaggcacaccatactctagtgcttttgggaagagtgaaagtaatgtgaaaacagctgtttttctgtctcccaagtttgaacttggaccgggttcggtagccaataaatttgattatgatattgattttccaagaggtcatattgccctcaagagtttcaatgctgaagtagttgatgaagcagggaactctgtggctctccatgaaacttatctccatcactgggttgttgcaagatactatcaacctaaatatgttaagacacacacaagctatgatggccataggatacttcataactctgatttcgtatttgtgaggaacagtggcttatgccagagaaatactcttggacagtactttggccttggatccgagacacgaggcacagctacggatgttccagatccttttgggatagctgtaggggatcctgcagaaattcctgaagggtatgaggagaagtggatgttcaatatccatgccattgatacacgcggtgtagtggataagagggggtgcactgagtgtaagtgtgagctttacaatgttacaaaggatgcatatggcaagcctctaatgccagactacaaaggaggtttgaaatgttgctatgatcaaacacagtgcaggttgagggaaggctttgagggcccaaagaggagcctctacctaagatacacagtaaagtgggttgactgggacaagtttcttgtgcctgttaagatttatatatttgatgtcactgatactataaaaatatcagatgattctggaggaatgatccctgagcatgattgccagattgagtatgacgttgaatcttgcagcactgaccaaaaggatggtaatggctgccttcatgtgcagaagacaagccttccactgcaaaagggtggttatgtcatctatggtgttgctcatcaacattcaggtggaactggatcaactctatatggacaggatggaagagttatatgttcttcgataccaagttatggaaagggaaaagaagcaggaaatgaagcagactacattgtaggaatgagcacatgttatcctcgacctggttctgtaaatataattgatggtgaaactttaactctagagtctaattacagcagcagccgtgagcacaccggagtaatggggcttttctatctattggtggcagaacaacttccacaccaacacttgaaacatacctctcggtcttcattctttatagatattaatagtatagttcattga

SEQ ID NO: 3197 - DNA, 1290 bp, Glycine Max; identical to SEQ ID NO: 3196

SEQ ID NO: 3198 - DNA, 942 bp, Glycine Max
atggcaaaaggtagcaggggaagacacaggattgcttctcgtcaattcagagtgactccatacccactggcttcttgcaaaagggacatttgtgaggacatgtgccaaaagaaatgttctaaggctttggaaaagaaagagttggaagatgttacgtgttctgtgtgcatggaatatccacacaatgctgttcttcttctttgttcttctcatgacaagggttgccgtccctatatgtgtggaactagctttcgtcattctaactgtcttgatcagtacaagaaagcttatactaaagtaatttcacctaataggcaacctatgcaaggcactccaggtgtgctacaagattcaaacttgcctcttgagaagagtgaagccacagagcttgcatgtcctctatgcaggggtcaggtgaaaggttggactgttgtggaacctgttcgggactatctgaatgcaaagaaaagaggctgcatgcaggatgactgcttgtatgttgggagctataaggagttgaagaagcatgtgcgggcagagcatccgtcggcacggccacggatggtggatcctgctgatgaacagaaatggagatggctcgagtgggagcgtgaaagagaagatgttatcagcacagttacatcagcaatgcctggggcagtagtttttggagattatgttatagaaggtcatcataatgactttgatacagatgaagaggagggttcaggtaatgcagaaagaaatggaagatttcagatgggtttagagacaatgataatgatggcaggtacaatgaagataatgatgatggtggtgtatctttggttagtcgtctccacggccatggcggtggcagagttttattgggtcgttctggtaggaggcgtagatgtagagaagcacgtgcaaggattggagatagttgaagatcgggcatga

SEQ ID NO: 3199 - DNA, 1074 bp, Glycine Max
atggcaaaaggtagcaggggaagacacaggattgcttctcgtcaattcagagtgactccatacccactggcttcttgcaaaagggacatttgtgaggacatgtgccaaaagaaatgttctaaggctttggaaaagaaagagttggaagatgttacgtgttctgtgtgcatggaatatccacacaatgctgttcttcttctttgttcttctcatgacaagggttgccgtccctatatgtgtggaactagctttcgtcattctaactgtcttgatcagtacaagaaagcttatactaaagtaatttcacctaataggcaacctatgcaaggcactccaggtgtgctacaagattcaaacttgcctcttgagaagagtgaagccacagagcttgcatgtcctctatgcaggggtcaggtgaaaggttggactgttgtggaacctgttcgggactatctgaatgcaaagaaaagaggctgcatgcaggatgactgcttgtatgttgggagctataaggagttgaagaagcatgtgcgggcagagcatccgtcggcacggccacggatggtggatcctgctgatgaacagaaatggagatggctcgagtgggagcgtgaaagagaagatgttatcagcacagttacatcagcaatgcctggggcagtagtttttggagattatgttatagaaggtcatcataatgactttgatacagatgaagaggagggttcaggtaatgcagaaagaaatggaagatttcagatgggtttagaggcaatgaatttcttcctcctgttgcatgcagttcggcaagggaatgagcttaacaaccttggtagacggctgaggcctgagctgacccacaacaacagggttgcaggtcagaatgcagctgccgtgctggatatttcagatgaagacaatgataatgatggcaggtacaatgaagataatgatgatggtggtgtatctttggttagtcgtctccacggccatggcggtggcagagttttattgggtcgttctggtaggaggcgtagatgtagagaagcacgtgcaaggattggagatagttga

SEQ ID NO: 3200 - DNA, 1074 bp, Glycine Max; identical to SEQ ID NO: 3199

SEQ ID NO: 3201 - DNA, 1074 bp, Glycine Max; identical to SEQ ID NO: 3199

SEQ ID NO: 3202 - DNA, 510 bp, Glycine Max
atggcaaatacgttgcggttatacttgacctgcattcggaacacgctcgaggccgcaatgtgcctccagaactttccgtgtcaagaagtcgaaaggcataacaagcccgaggttgaactcaagaccagccccgaactcctgctcaatcccgttttgatatgccgaaatgaggctgaaaaatgcttaatagaaacatctatcaattcattgcggataagtctcaaggtgaagcaggctgatgaacttgaaaacatattgaccaaaaaatttctaagatttctctcaatgagagccgaggctttccaagtactgaggagaaagcctgttcagggatatgacattagcttccttataacaaattaccactgtgaggagatgcagaagcacaaactcattgactttattgtgcaatttatggaggacattgataaagagataagcgagctcaaaatgtcggtgaacacaagggggaggcttgtagctacagagtttctgaagcagtttatctga

SEQ ID NO: 3203 - DNA, 1071 bp, Glycine Max; identical to SEQ ID NO: 366

SEQ ID NO: 3204 - DNA, 1587 bp, Glycine Max
atggcaaatgagggatcatcaaatccttctagcactgattctggatggaaatattgtactcgaggacaaggaaatagttgtgtatgcaatttctgtggcaaggttacaaaaggtggaattactagagcaaaagaacacttgatggcaaagcctggcaatgttgcagcctatgccaaatgtcccaaagaagttagagaagaactatggggatatttgaaggatacaaagaagcaagagagtgaaacatttcaaaggatgcgtcaacattttcttgaagactatggtgatagtgatgaagaaagagctcttgatgaagggtttgcaaatattgtatcaaggaaaagcattactaaaaaagagaaattaaggcaagaaagcataaggcagtcatgtgacaaggaggctactgcaagggttcatcaatacatagctcgattttggtaccaagctggcttgtctttcaacctagtcaagctgcaaagctttcacaaaatgcttacaaatgtgggagcctttggaccaaatttgaggcctccttcttatcatgagataagagttccacttctggccaaggagttagagaacacagaaattttgttgaaagaccaaaaggagctatggggaagatttggatgctcaattatgtctgatgtatggacagacagaaaacagagatctatcattaacttcttggtgaattgtacagcagggacaatgttctataaatcaattgatccatccaattttgtgaaatctggtgaaaagacatttgagttgttggactctattgtggaagagattggggaggaaaaggttgtccaagttataacaggcaatggaagcaactatgttttggcaggtaaatttcttgaacgaaaaaggtcacatttatattggattccttgtgcagcccattgcatagatttgatgttggaagacattggtaagttgccattgataaagaagacaattctaagagcaatatcccttgttggcttcatctatagccattcaagtactttgagcttgttgaggttcttcaccaacaaaagagaattggtgaggcatgcattactagtgagaaaaaaaccagccatgggttatatttatgaggcaatggagaaggcaaaagaagctataaggaagtcatttgaatataatgaaagcaagtataaagaagtgtttgaaattattgacagtaggtggacttgccaacttcatcaccccttgcatgcagctggtcactttctaaacccagatttattcttcagcaatcattctatggaatttgattttgaggtggtaaatggattgtatgtatgccttgaaaaattggtgcctgatcaagagtttttgaggaatagacagccaatgacgtataccaggcaaaagactaaaaagaaaaaggaaccagaatcccttggtgttgaagatgctacacctaagacaaaaagaggccaagtgagaggatcttcatcccttagaggaaaagagcaaatgattaaagttgaagataatgcagtcttggaagaatctgaagagttacaaggcattgattttggggactcagaagaagttagcttttag

SEQ ID NO: 3205 - DNA, 1131 bp, Glycine Max; identical to SEQ ID NO: 367

SEQ ID NO: 3206 - DNA, 528 bp, Glycine Max
atggcaacaacaacaccctcaaaccgatcatcagaggcgtttgctctcatggcaatcctcagcactctgctttgcacggcggtggcggcgaaggagagcgtgtacgagatactccccaagtacggcctcccgagcggtctgttaccggacaccgtcaccgactacacgctcgacgaggacgggcaattcgtcgtcgttttggcgaagccctgctacatacagttcgattacttagtttactacgagaccaagatctccggcaagctcagctatggctccatcaccaacctcaagggcattcaggtccagcgcctcttcatctggttcaacgtcgatgagatcaaggtcgatttgcctccctccaacagcatctacttccaggtcggcatcatcaacaagaaactcgacgttcaccagttcaaaaccgttcgctcctgccgcaaatccctctcttgcccaccttgccttccacgtccaattcagcttcctgctccggtcgatgaaattcccatgcttctcacggagtag

SEQ ID NO: 3207 - DNA, 498 bp, Glycine Max
atggcaacaacaacaccctcaaaccgatcatcagaggcgtttgctctcatggcaatcctcagcactctgctttgcacggcggtggcggcgaaggagagcgtgtacgagatactccccaagtacggcctcccgagcggtctgttaccggacaccgtcaccgactacacgctcgacgaggacgggcaattcgtcgtcgttttggcgaagccctgctacatacagttcgattacttagtttactacgagaccaagatctccggcaagctcagctatggctccatcaccaacctcaagggcattcaggtccagcgcctcttcatctggttcaacgtcgatgagatcaaggtcgatttgcctccctccaacagcatctacttccaggtcggcatcatcaacaagaaactcgacgttcaccagttcaaaaccgttcgctcctgccgcaaatccctctcttgcccaccttgccttccacgtccaattcagtacaacattgaataa

SEQ ID NO: 3208 - DNA, 1425 bp, Glycine Max; identical to SEQ ID NO: 368

SEQ ID NO: 3209 - DNA, 1356 bp, Glycine Max
atggcaaccgctcccttcattcacgcgcgctgtgcttactcgcctagaatttccaatcgcaacaacaagcctagttcgcaacaaggccccttggcttcttcgtcttctcatgcttcctcctcctcttcaccctccagttctagcttctctcacccttctggtacaaacagtggacaaagacaccagggccttagagctcaagctatgagtactgtcacacttggaaattctattgctagcatagggaatttgaagaacgatcctgatcatctccttgttcttgttcatggtatcttggctagcacagcagactggacttatgcggaagcagagttgaaaaggcgccttggaaaaaactttttaatttatgtaagttcatcaaatacttacactaagacatttactgggattgatggagctggaaagcgattagctgatgaagtcttgcaagttgttaaaaagacaaagagcctgaaaagaatctcctttctagcccattctctgggaggcttgtttgctagatatgcaattgctgttctttattcacctgatacttatagtagggaccaaccaggtgatctagcaaacagcatgacagaaaattcccagggaacaaccctttcaagaggagggatgattgctgggttagagccaatcaattttataactttagcaacaccacatcttggcgtgagaggaaagaagcagcttccatttctgttgggtgtcccaatcctagaaaagcttgctgcacctatagctcctttttttgttggtcagacaggtagtcagttattccttactgatggtaaacctgacaaacctcctctcctattgagaatggcttctgattctgatgatggaaagtttttatctgcacttggagcatttagatgtcgtatcatttatgctaatgtttcatatgatcatatggttgggtggcgcacatcctctataaggagggaaactgagctcagtaagaagcctcctcgccaatctttagatggatacaagcacgtggttgatgtggaatactgtcccccagttccttctgatggccctaaatttcctccaaaagcagtaaaagcaaaagaggcagcacaaaatgcgcccaatacacagaatactgtggaatatcatgaaattgtagaagatgagatgattcgaggattacagcagttgggatggaaaaaagttgatgtcagctttcactcagcattctggcctttctttgctcataacaacattcatgtgaaaaatgaatggtttcacaatgctggtgtaggagttattgctcatgtggccgaaagcttaagacagctagaagcatcatcatttttgtctgctagcttgtaa

SEQ ID NO: 3210 - DNA, 231 bp, Glycine Max
atggcaactcaaaagggactcgaagttccaaaaggctatcttgcagtctatgttggagataagatgaagcgatttgtgattccagtatcatacttgaaccaaccattatttcaagaattactgagtcaagcagaacaagattttggatatgatcatccaacaggtggtctcacaattccttgcaaggaggatgactttctaaacctcacttctcacttgaatgagctgtaa

SEQ ID NO: 3211 - DNA, 1107 bp, Glycine Max
atggcaactctagttgaacctcccaacagaattaagccaaagggcaagcattattatacaatatggcaaacattgtttgagattgatacgaagtatgttccaattaaacctataggccgaggagcgtatggcgtggtgtgctcttcgatcaacagggagaccaatgagaaagttgcaattaagaagattggtaatatatttgagaattctattgatgcattgagaactttaagggagctgaagctgcttagacatattcggcatgagaatgtcattgctttgaaagatgttatgatgccaatccacaaaacaagttttaaggatgtctacctggtctacgaactcatggatacagatcttcatcaaattattaagtcctctcagccactttccaatgatcattgcaaatatttcttgtttcagctccttcgaggtcttaaataccttcattcagcaaacattcttcaccgggacttgaagcctgggaatctgctcgtcaatgccaattgcgatttgaaaatatgcgactttgggcttgcacgaactaatggagttgatggccagtttatgacagagtatgttgtcactcgctggtatcgtgcaccggagctcttgttatgctgtgacaattacggaacctctattgatgtctggtcagtagggtgcatttttgctgagattcttggtagaaagccaatcttccctgggactgagtgtctcaaccagctgaaactaattataagcgttcttggaagccagcatgaatctcatcttgagtttattgataatgcaaaagcaaggaggtttatcaaatcactgccctatactaggggcagacacttctctcagctatacccacaagcagatccattagccatagatttgttgcaaaaaatgcttgtgttcgatccaaccaagagaattactgtcttggaagctctccaacacccgtatatggctagcctatatgatccaaggtgcgaccctcctgctcaggttcccatcagtctcgacatagatgaacattggggagaaccgatgattagggaaatgttttggaatgagatgctacattatcatcctgaagctgcttccgccaatgcataa

SEQ ID NO: 3212 - DNA, 1107 bp, Glycine Max; identical to SEQ ID NO: 3211

SEQ ID NO: 3213 - DNA, 954 bp, Glycine Max
atggcaagtagacaagtaagatgtaaccagtgtggatcagtattaatggttccggcggcagcggtccgtgttgttgagtgcagagtgtgccatggcatgaaccagattcgaccctccacaggtccatggagtcaaccactaaggccatcatacaatgtatttggcccaaagagggctgtcctatgcggaattcgctatcatgggcaggatagccagcagctaaacggcaccgtgaatgatgttaaaaacatgaatatgtttctggttaagtattgtgggtttcctagggaatccattctcattctcacagatgatatggaggagagagacccgctaaaattcccgacaaaatataacattcaaatggccatgaggtggctgattgagggtagccagtcaggggattcattggtgttccacttcgcagggcatggcgctcaggaaccggatatgtctggagatgaacttgataggtctgacgaagtaatatgtcctgttgattccagagagcagggaaatatacttgatgatgagattaatgctacaattgttaggccactaccacgcggtgctaaacttcatgccgttattgattcatgccatagtgggactgttcttgatttagcttatgtttggagcctgagcagggaaggctattggacatgggattatcaatactatcgagttcgtagacctaataaagacacaagtggaggggtagcaatttgcatttcaggttgccacgatgatcaatcgtccaaagaaacccctgccttaagtggtggctatgcgtttactggcgcctttacttatagtttcatctataccatgctaaatgaacctggactaagttatggtcgcttgctcagtgccatgcgttctatcatccgtgggataccaaatgacccatatgcttcgctctttaatacagattttatctttgcctcaagacag

SEQ ID NO: 3214 - DNA, 798 bp, Glycine Max; identical to SEQ ID NO: 369

SEQ ID NO: 3215 - DNA, 1314 bp, Glycine Max; identical to SEQ ID NO: 370

SEQ ID NO: 3216 - DNA, 1989 bp, Glycine Max
atggcaatgcatgcatttggcatccttttgggtgttctttactctctcttgagctttgtatcctcagatatcaattttgtaaaatatgggtttaagcaagcaggcttgaaaatggatggagcttcttatgtgaggccgaatggcatacttaccttgataaatgattcccccaaaatccttggccatgcattctatccatctcctttgccattcaaatctagcaaaaacaaatccattgttgcaacctttagcactacctttgtgttttccattgttcccaagtacccagaacttggtgcacaaggctttgcattcgtcctaatatccaccaacaaaccaaaagggtgcctcatgaatcaatatttaggcctcccaaatgtgacaagtagcctagaattctcaacccggttcctagccatagagtttgacgggatacagaacctggatcttcatgacatgaatgataatcatgtggggatagacatatccagcctcatctctaacatatctaggccagtggcatactacttgtcagatcacagcaagaacatttctttcagtctgaagagtggaaaacccattcaagcatgggttgattacaatgaaggagagatgttgatgaatgttacagtttctccttttggcatgccaaagccatattttcctttgatatcatttcccatagacctatccttggtgttgaatgactacatgtatgcgggtttttctgcttccaatggtttgctggtagctgagcataatatacatggttggggctttaaaatcggagaagcaggacaagagctagataaatcagctgttccacttattgggtcaagtactagtacttctagtaaggtggtgcacaaaaaagactttgcagtaggtatcactttaacaagtgcaactctttttatcttgacagttataggagcttttcatgtcctgcgcagattaagaaatggggacgagatattagaagattgggaacttgaatttgcctcccataaatttaaatattctgagctccattcagctacaggaaagtttggggatagcaaccttattgggtatggaggatttggtaaagtctacagaggagtaatcgcaagcacaggactagaagtagctgtaaagcgagttgctcctgattcaaggcagggaatcagagaatttgtttcagaaataacaagcatggcacaactaaagcatagaaatttggtgcagttacatgggtggtgcaggaagaaggatgaactcctcattgtttacaactatgtaccaaacgggagcctagacaagcttctgtttgaaaatgaacatcaaaagaagaaactactaacttgggatcaaagatacacgatcattactggtgttgctcaagggctgctgtatctccatgaagaatgtgaactgcaggttgttcacagagatgtaaagccaagcaatgtccttatagatgaagatctccaaccaaagcttggcgattttggtcttgcaaggacttacgagcatggaattaatccacagacaacgaatgttgtgggaacactagggtacatggcccctgagctcacaaagactgggaaagcaagaacaagcacagatgtatatgggtacggcatactcattttggaggtagcatgtggaaggaagccaatagagccacagaaaaatcccgaggaactggtattggtagactgggttagagaactacatcaccaagggaaaatcagcagggctattgaccccagtttagatgagtatgacaaagatgaagctcggcttgtgcttagtcttgggttgttttgtgctcatcccaatcctgattacaggcctagtatgagacggattgtccagttccttctgggagaaaccagccttcctccgcttcctccggacattcacttcttacatgctttgatgaggtggtctcagctactgaagccactggcaaagcatattaaagaaccacattgttttggataa

SEQ ID NO: 3217 - DNA, 2052 bp, Glycine Max
atggcaatgccatcgggaaatgtggtaatacaagacaaaatgcagtttccaagtggtgctggtggcggtggcggcggcggcggtgctggcggagagatccaccagccccaccactaccgcccgcaatggtttgttgatgagagggatggacttattggttggctgcgaagtgaattcgcagctgccaatgccatcatagactccctttgtcaccatttacgtgttgttggtgatcctggggagtatgatatggtcgttggggccattcagcagaggaggtgtaattggaaccaggtgctgatgatgcagcaatacttttctgtggctgacgtggcatatgcgctgcagcaagtggcgtggaggagacagcagaggcctctggatccaatgaaagtgggtgcaaaggaagttaggaaatccggttctggataccggcatgggcagaggtttgagtctgtaaaggaaggttataattctagtgtagagtcttatagtcatgatgcaaatgtcgcagttactggaggcacggagaaagggactccagttgttgagaagagtgaagaacataaatcaggtggaaaggttgagaaagtgggggataagggtttagcatctgttgaagagaagaaagatgctataacaaatcatcaaagtgaaggcagcttgaagagtgcaaggagtactgaaggatctttgtctaacttagaatccgaagctgttgtaaatgatggatgtatatctaattctaaagggaacgatttacattctgtgcaaaatcaaagtcagagccaaagtctttctaacatagcaaaaacttttattggcaatgaaatgtttgatgggaagacggtgaatgtggttgatggactaaagttgtatgacgatttatttgatagcactgaagttgcaaatcttgtttcactggtcaatgatctaagggtttctggaaaaaaaggacagttacaaggaagtcaggcatatatagtttcaagaaggcccatgaaagggcatggaagggagatgattcagttgggtgttcgaattgctgatgccccagcagaaggggaaaatatgacaggagcctccaaagatatgaatgtagaatctattccttccttgtttcaagatattattgagcgtatggtttcctcgcaagtaatgactgtgaagcctgattgctgcattgtggatttctataatgagggtgatcactcacaaccccacagttggccatcatggtatggaaggcctgtttatgtgctttttctgactgaatgtgaaatgacttttggaagagtaattgcctcagagcatcctggggattataggggcagtatcaagctttctctagttcctgggtcccttctggttatgcagggtaaatccagtgattttgctaagcatgctcttccttccacacgcaaacaacgcatactggttaccttcacaaagtcccaaccaagaaagtcactatcaagtgatgctcaacagcttgcctcggcagtagcatcttctcattggggtccaccgccaagccgatctcccaatcatgttcgtcatcacgtaggccccaagcattacgctacacttccaacaactggggtactgccagctccacccattcgaccacaaatggcagctcccgttggcatgcaaccattgtttgttgctgctccagttgtacctcccatgccattttctgcacctgtgccaatcccagctggttctaccggatggacagctgcacctcctccaaggcatcctcctcctcgagtccctgctcctggaacaggagtcttcctacctccatcgggctcaggtaattcatctcaacagttaccagcaagtactttggctgaagtgaacccaagcacggaaactccaaccatgccggagaaggaaaatgggaaaattaatcataatagtacaagtgcttcaccaaaaggaaaagtgcaaaagcaagaatgcaatgggcatgctgatggaactcaagttgaaccagctctagagacacggctagatagcaatgacaaagctgcaccaagtcattga

SEQ ID NO: 3218 - DNA, 1488 bp, Glycine Max
atggcacaacaacaagaacatgaaggaaaaccagagtcttcttcctctcaacctgagtcttctttggaaccagacatgggcaccaagtccacaatgattccgtcaacttcatggtttacaccaaagaggttactggctatattttgtgtgatcaacttgttaaactatttggaccgaggagcgattgcaagcaatggggttaatggaagtcaacgaacttgtgaaggcggtacctgcaaatctggaacaggaatacagggggattttaacttgaacaattttgaggatggagttctatcatctgcttttatggttggacttcttgtggcttctccaatatttgcttctctagcaaagagactaattggagtgggattatcagtttggacccttgcaaccttatgttgtggtttctctttcaatttctggtccattgcagtctgtcgcatgctagttggtgttggtgaggcttcatttatgagtcttgcagcacctttcattgatgacaatgccccagtttcacagaaaacggcatggcttgctatattttacatgtgtataccagcaggatatgcaattggctacatctatggtggtttggttggaaaccattttggttggcgttatgcgttttgggtggaagctatattgatgtttccatttgctattttgggattttttatgaagcctttgcagttaaaaggtgcacattcttctcctgcattgatttcttgcagctccataacttcgtttcccatcactaaactacttgtgcatccagatgtcggggtttcaaatggaaaagatgaagcgttgtccttgaaggaagagttcagagacaaaagctcacatgaaccttccaggtcaaaatgtgcaatattagatcagttctcaagatttctgaaagacatgaaagaacttttgcttgataaggtttttgttgtcaatgttctaggttacatagcatacaactttgtaataggtgcttactcatattggggccccaaagctggttatagtatatataacatgactaatgcagatatgatgtttggaggaattactgttgtatgtgggatattgggcaccttagcaggaggtcttgttcttgatttcatgactaacacaatatcaaatgcatttaagcttctctcattaacaacatttattggtggtgcatgctgttttggtgctttcttatttaaaagcgagtatggcttccttgccctttttgcttttggtgaactacttgtatttgccactcagggtcctgtgaattatgtatgtctccattgtgttaaaccaagtttgaggccgctgtctatggctatgtctactgttgctattcatatctttggagatgtgccttcctcacctctcgttggacttatccaggacaaaattaataactggagaacgactgcattgattctaacaactatattctttccagcagctgcaatatggtttataggtaagtcattatga

SEQ ID NO: 3219 - DNA, 402 bp, Glycine Max; identical to SEQ ID NO: 371

SEQ ID NO: 3220 - DNA, 921 bp, Glycine Max
atggcaccccaacggccggctgtggtgactaaagagagaagagtctcagttcacaagagatggatcattgatgatgcaacaggaaaacgtgtgaagcttcattgtgcacattgggtggctcatgcaacgccaatgcttgctgagggtcttgacaaatcgcccatgaatgacattgctgctaatatagccaaagcaggattcaattgtgttcgtttgtcctatgctacgtacatgttcactcgctatgctaataacactgttcgtgacatattccacactcatgatattccgggcattgtgtcagcaatcgagaattataaccctagggtgttgaacatgacccatcttcaggcctatgaggctgtggttgatgctctaggggatcatggcgtgatggtgctcattgataaccatgttagtttggcaaagtggtgctgtgccaatgatgatcaaaatggattctttggagataggcattttaacacttctgaatggcttcaagggttggcttttatagcccaccatttcaaaggaaaacccaatgtgtttgctatggacttgcgaaacgagctaaggggttcgcgtcaaaaccaccatgattggtacaagtacatgacccaaggagcaaacacaatccacgacatcaaccccgattttatagttatcatttcagggttagcctttgacaacgaccttagcttcttgaagaaaaaacctcttgacttaaacttccctcacaaaatagtgtacgagtcacacatctattccgtctcaggagatacacacaggtggcgcgtgcaaccagtgaattggatatgcaacgccacaattcaattgttgcaccaacaatcaagctttcttctgagtgcttgtgggctttccaaggaagctattactatagacaaggcaaagttggactag

SEQ ID NO: 3221 - DNA, 3240 bp, Glycine Max; identical to SEQ ID NO: 372

SEQ ID NO: 3222 - DNA, 570 bp, Glycine Max; identical to SEQ ID NO: 373

SEQ ID NO: 3223 - DNA, 1014 bp, Glycine Max
atggcacgcaagaagatcagagagtatgactccaagagattgttgaaggagcactttaagagactctctggccaggacttgcccatcaagtccgcacaagttacagaatccaccgatttcaatgagctaacagagaaggaaccctggcttttatcttcaaaattggttgtgaaacctgacatgctatttggtaagcgtggcaaaagtggtttggttgccttgaatctggatttggcagaagttgattcttttgtgaaagagcgtcttggcaaagaggttgagatgggtggatgcaaaggacctataacaactttcatagttgaaccttttatccctcacaatgaggagttttaccttaacattgtctcagagagactagggaatagtataagcttttctgaatgtggaggaattgaaattgaggagaattgggataaggtcaagactgtatttatgccaacaggagtgtctcttacatcagagagtattgccccacttgttgcaacccttcccttagagatcaagggagaaattgagggatttctaaaggtgattttcgctctatttcaagatctggattttactttcttggagatgaatcctttcactttggtcaatggaaagccttatcctctggacatgagaggcgagcttgatgatactgctgctttcaagaacttcaagaaatggggaaacattgaatttccattgccatttggaagggttatgagtactacagaggcttttgttcatggattagatgaaaagacaagtgcatctttgaaattcacagtattaaacccaatgggccgaatttggacaatggtagctgggggaggtgctagtgtcatctatgctgatacggtaggggatctcggttatgctcctgagcttggaaactatgcagaatatagtggtgcacccaaggaagatgaggtcttgcagtatgccagagttgtgattgatgtaatcgattcttatctcaaacatcattgttggcatatttatggataa

SEQ ID NO: 3224 - DNA, 1272 bp, Glycine Max
atggcacgcaagaagatcagagagtatgactccaagagattgttgaaggagcactttaagagactctctggccaggacttgcccatcaagtccgcacaagttacagaatccaccgatttcaatgagctaacagagaaggaaccctggcttttatcttcaaaattggttgtgaaacctgacatgctatttggtaagcgtggcaaaagtggtttggttgccttgaatctggatttggcagaagttgattcttttgtgaaagagcgtcttggcaaagaggttgagatgggtggatgcaaaggacctataacaactttcatagttgaaccttttatccctcacaatgaggagttttaccttaacattgtctcagagagactagggaatagtataagcttttctgaatgtggaggaattgaaattgaggagaattgggataaggtcaagactgtatttatgccaacaggagtgtctcttacatcagagagtattgccccacttgttgcaacccttcccttagagatcaagggagaaattgagggatttctaaaggtgattttcgctctatttcaagatctggattttactttcttggagatgaatcctttcactttggtcaatggaaagccttatcctctggacatgagaggcgagcttgatgatactgctgctttcaagaacttcaagaaatggggaaacattgaatttccattgccatttggaagggttatgagtactacagaggcttttgttcatggattagatgaaaagacaagtgcatctttgaaattcacagtattaaacccaatgggccgaatttggacaatggtagctgggggaggtgctagtgtcatctatgctgatacggtaggggatctcggttatgctcctgagcttggaaactatgcagaatatagtggtgcacccaaggaagatgaggtcttgcagtatgccagagttgtgattgattgtgcaacttcaaatcctgatggccaaaagcgagcccttgtgataggtgggggaatagctaactttactgatgttgctgctacgttcagtggcataattcgtgctctgaaggagaaggaacaaaagctaaaagaagcaaagatgcacatctacgtgaggagaggaggtcccaactaccagaagggtctagcaaaaatgagggcacttggagaggagattggcattcctatcgaggtttatggacctgaggcaacaatgactggtatatgcaaacaggcaatccaatgcatcactgctgctgcttaa

SEQ ID NO: 3225 - DNA, 978 bp, Glycine Max; identical to SEQ ID NO: 374

SEQ ID NO: 3226 - DNA, 630 bp, Glycine Max; identical to SEQ ID NO: 375

SEQ ID NO: 3227 - DNA, 630 bp, Glycine Max; identical to SEQ ID NO: 375

SEQ ID NO: 3228 - DNA, 726 bp, Glycine Max; identical to SEQ ID NO: 377

SEQ ID NO: 3229 - DNA, 669 bp, Glycine Max; identical to SEQ ID NO: 378

SEQ ID NO: 3230 - DNA, 738 bp, Glycine Max
atggcactgtccaaccgcgtccgatcgggaatctctctcttcaccaaatccacgttcctcacttccgagcgatccactctccaacgattcctcgttgccccttccatttccttcgcctccagaaattacgccaacgtgccggggcaaaaggaaaacaaagttaaggtccctctggctttgtttggaggttcaggaaactatgcctctgctttgtatattgcatctgtgaaagctaatgcagtggcaaaggttgagtctgagcttctgcaatttgttgaggctgtaaagaatagtcccatattttcacagtttataagggacttgtctgtggctaaggatgttagagtaaaagtcatccaggatatttgtggtgaagctaagttttcagacgttacaaagaacttccttgttattgttgctgagaatggaaggcttaaaaacatagacaccattgcaaagaggtttgcgcagttgtcaatggcatataaaggagaagtgcaagcaactgtgaccactgttgttcctcttccccctgaagaggaaaaggcattgaaggagactcttcaggaaataataggttctggagcaaaggttcatcttgaacagaagattgatccaagcatacttggtggtcttgtgcttgaatttagccagaaggtctttgacatgtcaattaagaccagggcacaacagatggagaggatcctccgtgagcctgtatcgattgccaacatctag

SEQ ID NO: 3231 - DNA, 1587 bp, Glycine Max
atggcagaggtggcggcgccgaagaaggaaaacccgaatcttctccttgggcggttcgagctcggaaagctcctcgggcacggaaccttcgcgaaggtccaccacgcgcgcaacatcaaaaccggagaaggagtcgccatcaagatcatcaacaaggagaaaatcctaaagggtggtttggtctcccacatcaagcgcgagatctccatcctccgccgcgtgcgccaccccaacatcgtgcaactcttcgaagtcatggccacaaagaccaagatctacttcgtcatggaattcgtccgtggcggcgaactcttcaacaaggtcgcaaagggaaggttaaaagaagaagtcgccagaaagtacttccaacagttggtttccgcggtggagttttgccacgcgcgcggcgtgttccacagggatttaaagcccgagaatttgttgctggacgaggatgggaaccttaaagtctccgactttggactcagtgccgtgtcggaccagataaggcatgacgggctgttccacacgttttgcggaacacccgcgtatgttgctcctgaggttttggcgcggaaagggtacgatggtgcaaaggttgatatttggtcttgtggggttgttttgtttgttttgatggcgggttatttgcccttccatgaccgtaacgttatggctatgtataagaagatttacaagggtgagtttcggtgtcccaggtggttttcttctgaacttacaagacttttctctaggcttctcgatactaaccctcagacaaggatttctattcccgaaatcatggagaatcgctggttcaagaagggtttcaagcagattaagttttatgtggaggatgatagagtttgtagttttgatgagaaacagctgcagcatcatgatggcgatgattatttggcaacatcggattctgaggttgagattagaaggaagaatagtaattgcaatagtactagtaatggtaattcgttgccgaggcctgcgagtttgaatgcgtttgacataatatcgttttctcaaggctttgatctatcagggttgtttgaggagaagggtgatgaggcgaggtttgtgtcttctgctccggtgtcgaagattatatcgaaattggaggaggttgctcagttggttagcttcactgtgaggaagaaagattgcagggtgagcttggaggggtgtagagaaggtgtgaaagggcctttgactattgctgctgagatttttgagttgacaccttccttggtggtggtggaggtgaagaaaaaaggaggggataaggcagagtatgagaagttttgtaactctgagctgaaacccgcgttggagaatttggggatggaggattctgcttcttcttcttcttcttgtcatcaatctacacacactcaatctgaattccaacaacaacatcgaacattttctgactctgcccttaacagacattcagataataatgaatgcttatatgatcaagagttgggtctagcagaagagactagtatcccacaacttggtgaaccaaagttcgaatttcaacaggaaaatgtgcccatgtttactatttga

SEQ ID NO: 3232 - DNA, 864 bp, Glycine Max
atggcagataatcttgttctccgtggcaccatgcgcgcccacaccgacgttgtgacggcgattgccactcccatcgacaactccgacatgatcgtcaccgcctcacgcgacaaatccatcatcctctggcatcttaccaaggaggacaagacttacggtgtcccccgccgccgcctcaccggccattctcattttgtccaggacgacgtgctctccgtggccttttccattgacaaccgtcagatcgtgtctgcctctcgtgaccgcacgatcaagctgtggaacaccctgggagagtgtaagtacacaatccaagacggcgatgcgcattctgattgggtaagctgcgtccgtttcagccctagcacccttcagcccactattgtttctgcctcgtgggaccgcaccgttaaggtttggaacctgacaaactgcaagttgaggaacacgcttgctggacacaatggttatgtgaacactgttgctgtttcccctgatggctctctgtgtgccagtggtggcaaagatggggttattcttctgtgggatttggctgagggtaagcgtctttactccctcgatgctggttctatcatacatgcgctctgcttcagccccaacaggtactggctttgcgccgccactgaacagagcatcaagatctgggatttggagagcaagagtatcgttgaagatttgaaggttgacctaaagactgaggctgatgccaccaccggtggtggtaaccccaacaagaagaaggttatctactgcacaagtttgaactggagttcggatggaagcactttgtttagtggctataccgatggcgtggtcagagtttggggtattggtcgttattag

SEQ ID NO: 3233 - DNA, 978 bp, Glycine Max
atggcagataatcttgttctccgtggcaccatgcgcgcccacaccgacgttgtgacggcgattgccactcccatcgacaactccgacatgatcgtcaccgcctcacgcgacaaatccatcatcctctggcatcttaccaaggaggacaagacttacggtgtcccccgccgccgcctcaccggccattctcattttgtccaggacgtcgtcctctcttctgacggccagtttgccctatccggctcctgggacggcgagctccgcctctgggaccttgctgctggcacctccgctcgccgctttgtgggccacaccaaggacgtgctctccgtggccttttccattgacaaccgtcagatcgtgtctgcctctcgtgaccgcacgatcaagctgtggaacaccctgggagagtgtaagtacacaatccaagacggcgatgcgcattctgattgggtaagctgcgtccgtttcagccctagcacccttcagcccactattgtttctgcctcgtgggaccgcaccgttaaggtttggaacctgacaaactgcaagttgaggaacacgcttgctggacacaatggttatgtgaacactgttgctgtttcccctgatggctctctgtgtgccagtggtggcaaagatggggttattcttctgtgggatttggctgagggtaagcgtctttactccctcgatgctggttctatcatacatgcgctctgcttcagccccaacaggtactggctttgcgccgccactgaacagagcatcaagatctgggatttggagagcaagagtatcgttgaagatttgaaggttgacctaaagactgaggctgatgccaccaccggtggtggtaaccccaacaagaagaaggttatctactgcacaagtttgaactggagttcggatggaagcactttgtttagtggctataccgatggcgtggtcagagtttggggtattggtcgttattag

SEQ ID NO: 3234 - DNA, 1134 bp, Glycine Max; identical to SEQ ID NO: 379

SEQ ID NO: 3235 - DNA, 579 bp, Glycine Max
atggcagcaccaaagctggttcctttattgttattactaaccataataacaacaacgaagaatgtgttgggtcaaggaggaacagcgagctggtgtgtagcgaggagtgacgccagcagcgacgcactgcaaacggcgttggactatgcttgtggggccggtggggattgtcttcctcttcaaccagatggactctgttttctccctaacaccattcaagctcacgcttcttatgccttcaacagctactaccagcgcaggaccagagctcctggttcatgtgattttgctgccactgccaccattgccactagtgatcccagctatggatcttgtgtttacccttcttctgcaagtgctgctggaggaccaaatacaccaaccacaacacctccaatgaacaacccaaatgtgcctacatctaccacaacaacaccaatctttggtgggggcaacactggtggactaactcctggaatgagcactccattcccagacagttctagagcacattcagaggcaacagcaacatggtttttagctttatgttcctctcttattatattcattatctcttag

SEQ ID NO: 3236 - DNA, 1764 bp, Glycine Max
atggcagcactcaattcaagcacttgtgccaaacctcaattccctcaccctctctcctcctctttctcttcttcttcatcattaacaagagatttgggcttccccacaaggtttcagaagaagcccattagaaaggtggtggattgtgctctacactcccccccagtgatccatttcccaaaccagccctacaacaaacctgaaattaccaaagaacccaccacctccaccgcggaaaggcctcagtggaacccattccaaaaagccgcagcaaaggccctcgacatgttcgagagcgcgttgctctcacgcgagctcaaccaaccctttcccaaaaccactgacccacgcgtccaaattgccggtaacttcgcccccgttccggaacaccccgtcgaacattctctccccgttattggcacaatccccgacgccattaacggcgtctacctccgtaacggcgccaacccattgttcaagccaaaagcgggccaccacctcttcgacggcgacggaatggtccacgccgttaaattcaatgacggcaccgccagctacgcgtgccgcttcaccgaaacgcagcgtctcatgcaggagcgcaaattgggaaaacctgtgtttcccaaggcaatcggcgaactccacggccattccggcatcgcgaggttgatgctgttctacgcaagaggcttgtgcggcatcgtcgaccaccgcagaggcgccggcgcagccaacgccggcctcgtcttcttcaacggaaaactcctcgccatgtcggaggatgatttcccctacgaactccgaatcaccgcctccggcgacctcgaaacaattggccgctacagctttcacggccagctcaattcctccatgatcgcgcatccgaaggtcgatcctgtctccggagagctttttaccctaagctacgacgtcacgagcaagatcctcaaatacttccatttctcgcccgaggacgagaggaagtcgccggacatagaaattccccttgacgcgccgacgatgacgcacgacttcgcgatcacggagaatttcgtggtgatcccggaccagcaggtggtgttcaagctcggcgaaatgatcaaaggaggatcgccggtgatctacgacggcgagaagaaatcgcggttcggaatactgccaaagtacgcttccgacgcgtcgagcatcgtgtgggtggactcgccagacacgttcttcttccacttctggaacgcgtgggaggaacgcgacaaagacgaagtggtggtaataggttcgtgcatgacaccaccagattcaatattcaatgacagagaagagagactgaagagcgttttaacagaagtaaggctgaacatgagaagcgggaaggcgaggaggagggtgctggtggaggaaatgaacctggaggcagggatggtgaacaggaaaaggttggggagaaaaacacggttcgcatatttgtgcatagcggaaccgtggccgaaggtgtcgggggtggcgaaggtggacctggagagtggggaagtgaagaggcacgagtacggagagagaaggttcggtggagagccattcttcttgccaacacgtggagggaatgggaatgaggatgaagggtacgtgatggcttttgtgcatgacgagatgacgtggcagtccgagttgcagattctgaatgcacttgatttgaagttggaggccactgtcatgctgccttcaagagtgccctatggcttccatggcacgtttgtggaggctcattga

SEQ ID NO: 3237 - DNA, 213 bp, Glycine Max
atggcagcagattggggcccagtggtgatatcagtggtgctgtttgtgctattaagcccagggttactgtttcagcttccagctaagggcaaggtggtggcatttgggagcatgcaaactagtggcttatccatcttagtccacaccatcatcttctttggactcatcaccatctttctacttgccattggtgtgcatatttactctggataa

SEQ ID NO: 3238 - DNA, 936 bp, Glycine Max
atggcagcagcttcttccatggctctctcatccccatccttggctggcaaggccgtgaagctgggcccatcagccccagaagtgggaagggtgagcatgaggaagaccgtcaccaagcaggtctcctcaggaagcccatggtacggcccagaccgagtcaagtacttgggcccattctctggcgagcccccgtcctacctaaccggtgagttcccaggcgactacggctgggacactgctgggctttccgcagacccagaaaccttcgccaagaaccgtgaactcgaagtgatccactccaggtgggccatgctcggagccttgggctgcgtcttcccggagttgctgtcccgcaacggggtgaagttcggagaagccgtgtggttcaaggccgggtcccagatcttcagcgagggtgggctcgactacttgggcaacccaagcctgatccacgcccagagcatcctcgccatctgggccacacaagttatcctaatgggtgccgttgaaggttaccgtattgctggtggccccctcggtgaggtcactgacccaatctacccaggtggcagcttcgacccattgggccttgctgatgacccagaggcttttgctgagcttaaggtgaaggaactcaagaacggacgattggccatgttctctatgtttggcttctttgttcaggccattgtcaccggaaagggtccattggagaacctcgccgatcaccttgctgaccctgtcaacaacaacgcctgggcctatgccaccaacttcgtccccggaaaggccactaataatcacacaaaaggaaagaaacaatatgacaacaaaattcgaccattattatcactgtcatcgaattccaatttcttctcctcactaaaacaggtatgtatatgtaattgtaatttcaacatcgtcacatgttcttaa

SEQ ID NO: 3239 - DNA, 792 bp, Glycine Max
atggcagcagcttcttccatggctctctcatccccatccttggctggcaaggccgtgaagctgggcccatcagccccagaagtgggaagggtgagcatgaggaagaccgtcaccaagcaggtctcctcaggaagcccatggtacggcccagaccgagtcaagtacttgggcccattctctggcgagcccccgtcctacctaaccggtgagttcccaggcgactacggctgggacactgctgggctttccgcagacccagaaaccttcgccaagaaccgtgaactcgaagtgatccactccaggtgggccatgctcggagccttgggctgcgtcttcccggagttgctgtcccgcaacggggtgaagttcggagaagccgtgtggttcaaggccgggtcccagatcttcagcgagggtgggctcgactacttgggcaacccaagcctgatccacgcccagagcatcctcgccatctgggccacacaagttatcctaatgggtgccgttgaaggttaccgtattgctggtggccccctcggtgaggtcactgacccaatctacccaggtggcagcttcgacccattgggccttgctgatgacccagaggcttttgctgagcttaaggtgaaggaactcaagaacggacgattggccatgttctctatgtttggcttctttgttcaggccattgtcaccggaaagggtccattggagaacctcgccgatcaccttgctgaccctgtcaacaacaacgcctgggcctatgccaccaacttcgtccccggaaagtga

SEQ ID NO: 3240 - DNA, 2091 bp, Glycine Max
atggcagcatcatcagcatgccttgtagggaatggtttatctacacggggtaatagaataactcttaagaaggacttcaatggaagaagatatctctactcatcttggagattttcattattgaacaacaataaggcatcaaaagcattttccataaaggcatctttggagcaaaggcaagaagaagggagaagggggtttctgaaactgttgcttggaaatctgggagttggtttgcctgcactattgggaagtggcaaagcttatgctgatgaacaaggggtttcatcctccagaatgtcttactccaggtttctggagtatttggacaaggacagagttaaaaaagtggatctttatgacaatggaaacactgctgttgttgaggctgtttcgcccgagttggggaaccggtcacagtatgttagagttcaactccctggacttaaccaagagctccttcagaaattcagggaaaagaatattgactttgcagctcatagtccccaagaagagtcaggttctcttttagctaacctgattgggaatctggctttccctttgctcttgattggaggattgttccttctctcgagacgatccggagggatgggaggtcctggtggccctggatttcctcttgcttttggtcaatccaaagccaagtttcaaatggaaccaaacaccggagtgacatttgatgatgttgctggggtggatgaagccaagcaggactttatggaggtggtggagtttttaaagaagcctgagaggtttactgctgttggggctcgcattcctaaaggagttcttcttgttggtcctccaggaactgggaagaccttgttagccaaggctattgctggtgaagctggtgttccatttttctctatatcaggttctgagtttgttgagatgtttgttggtgttggtgcttctcgtgttcgtgatttgttcaagaaggcgaaagagaatgccccttgcattgtctttgttgatgaaattgatgctgttggaagacaaagagggactggaattggtggagggaatgatgaaagagagcagaccctcaaccaacttttgacagaaatggatgggtttgagggtaacacaggtatcattgtcgttgcagcaactaacagggctgacattcttgactcggccttgttgagacctggccgatttgatagacaggtgacagttgatgttccagatataaggggaaggactgaaatcctaaaggttcatgctagcaacaaaaagtttgatgctgatgtttctcttgaagtgattgcaatgagaacacctggctttagtggagctgatcttgcgaatctgttgaatgaagctgctatattagctggtcgccgtggaaagacagctatttcatctaaagaaattgatgattctattgataggattgtggctggaatggaaggaacagtgatgacagatgggaagagcaaaagtttagtggcatatcatgaagttggtcatgctatttgtggaactttgactcctggtcatgatgctgtgcaaaaggtaacactagttcctcgcggtcaagctcgtggacttacatggttcattcctaacgatgacccaactctgatctccaaacaacaactctttgcaagaattgttggaggactaggtgggagggctgcagaagaaattattttcggtgagcctgaagttacaactggagcagctggtgatttgcagcaaatcaccagtttggcaaaacagatggtgaccacatttggaatgtctgatattggtccttggtcacttatggaaccatcagcacaaggtggggatgtcatcatgagaatgatggcaaggaactcaatgtcagagaggcttgcagaagacattgatgctgccatcaagaggatctcagatgaagcatatgaaattgcactggagcatataaggaacaaccgtgaggccattgacaagattgtggaagtccttctggagaaggagactctgagcggagatgaattccgtgctatattgtctgagtttgttgaaattccagctgaaaaccgtgttgctccttcaactccagtaccagccactgtttga

SEQ ID NO: 3241 - DNA, 1980 bp, Glycine Max
atggcagcatctcgttactgtaagaaaacttatgtacgtgcttattttctgcatgtaacattaatattcttgctccttgtaattcctcgtgcagcagcttcattagccttcaactatcagcaacttggtgacacgggaaacgccctcaagacttcaggagatgtctatcctgaccaagatgtcctcctactcacccgttatgagccagatagttatggtagagttacatattacgaaaatttgcatctttgggacaagaactcaggaaaagtcacagacttcactacccatttctcctttaccatcaacacccccaataaaacccatcatggagatggcatcaccttctttcttgcacacccagactttccacaatcgggcatagatggaagcggtatcggtcttgcgagccgcgaacaacttaagaatctgaattacgcgaaggattatccgtttgtagcggtggaattcgatacctttgttaatgactgggatcctaaatatgaccatgtcggtatcgatgttaattctatcaacactactgacactacggaatggttcacaagcatggatgagagaggatatgatgctgatattagttacgattctgcttcaaacagattaagtgtcaccttaactggatataaggatagtgtcaaaattaaacagcacttattctctgtggtcaatctgagtgatgtcttacctgaatgggttgaaattggcttctcttcagcaacaggatttttttatgaggaacatactcttagctcatggtccttcaactctagtttagacaaggaacaacaaaagggtggaagcaaaattgggctggtgatagggctgagtgttggacttggtgcagggctgagtgttttaattgttatttggggggtaactttccttgtgagatggatgctgaagaatagaggtttggaggaagtctcactttttgatcatgctatggacaacgatttcgaaagaatgtctctacccaagaagttttcctatgaagaacttgccagagcaactaataactttgcaagagaaaacaaaattggagagggaggttttggagcagtctacaggggacttataagagagttgaacatccatgttgccattaagaaggtatctcgcagatctagtcaaggagtgaaggagtatgcatctgaagtaaagatcattagccaactgaggcataaaaatttggttcaactcttagggtggtgccatcagaacaatgacctgctgctggtttatgagttcatggaaaatggaagcttggattcttatctgtttaaaggaaaaggccttctggcatggaaagtgagatatgatattgctagaggcctggcctccgcattattatacctgcatgaagagtgggaagaatgtgtgcttcatagggacataaaatccagcaatgttatgttggattctaattttgatgcaaagcttggtgattttgggttagccagactaatggatcatgcaataggttcaaaaacaactgttttagcaggaacaattggatatttgcctcctgaagctgtcacaagaggcaaggctagtagggagtctgatgtattcagttttggagttgctgctttggagatagcctgtggtagaaaggcaattgaacctaatgtgaatgaagaacagctctatttggtggattgggtttgggaactccatggcatggttgatcttcttaaagcatctgatccaagcttatatggacactttgatgagaaggaaatggagaggttaatgatagttggcctgtggtgtacttacacagatttccatctgaggcctacaattaggcaagttgttcaggtgcttaattttgaagctccacttcccactctctcaccacaggttccatccttttcctataattcatctttcagctctatgccctctaggacttctgcttttgcaaataaccaatgtgtctcttcaacttcaatgtaa

SEQ ID NO: 3242 - DNA, 384 bp, Glycine Max
atggcagcgagactcgcgattgagaggagcaccagatggagattgagcagcgttttagggttcaataggtggattcagtcggtgccccaatctcctcctttagctggaagcattgatcttggggttcggtcgccgcaacccgttttgcccgagttttcccccccaagtttctcttatgggagctccatggagctcatggctgtcccaaaacgcaaggtttctccccataaaagaggaataaggaatggaccaaaagctctaaaacctattcctgtgattgtcctatgcaagagttgtggtcgtgctaggcttccacacttcttttgttgtggtgggaaaccaaatcagggtaatactggtgaacagaaaggtagtacaagctaa

SEQ ID NO: 3243 - DNA, 861 bp, Glycine Max
atggcagcgttccgatggaagagcttcgaggagaatgaggatcgcccagccaagcctcgtcattttggcgtcaccgagattcaaagcccccactgcactctcttctcccacaaccttcttcaggatatttttgaatctatgggagactatgtagatgggttaaagttttctggaggttctcacagcatgatgccaaaggctactatcaagcaaatcattgacatggcccatcagcatgacgtgtatgttagcacgggtgattgggctgagcacatgattagcaaaagtccatcaggtttcaaggaatatgtagaggaatgcaagcagttggggtttgacacaattgagctcaatgtgggatcgcttgagattcctgaagaaacctttttgagatttgtccgcttggtcaaaagtggtggtctcaaagctaagcctcattttcaagtgaagtttaatgagtctgatattcccaaaggtggtgacagggcttatggggcttatattccccctgtacctagatcatttgaattggtagaagatgtgaatctcttgatcagaagggctgagagatgtctggaagcaggtgcagacatgataatgattgatgctgatgatgtcagcaaacatgctgataacatgcgtgcagacatcattgccaaaatcatagggcgccttggtattgagaagactatgtttgaagcatcaaatcagagaatatcggagtggttcatcaaacaatatggtccaaaggtgaacctctttattgatcattcgaacgtggtggatgtggagtgcctcagggggcgcaacttgggtagaaatcttgcttctttccttggtgcttcagatttcctgttctga

SEQ ID NO: 3244 - DNA, 777 bp, Glycine Max
atggcagctgcaacatctagtgctgtgttaaacgggtttggatctcacttcttgtgtggaggaaagaggagccatgcccttcttgctgctagcattggagggaaagttggtgcttctgttagtcctaaaagagttattgtggcagttgctgctgcaccaaagaagtcatggatccccgctgtaaaaggtggtgggagtttcatagacccagaatggcttgatggctcgctaccaggtgactatggttttgacccactaggactaggaaaggacccggcattcctgaaatggtatagagaagctgaactcattcatgggaggtgggcaatggctgcagttgtaggcatcttcattgggcaggcatggagtggagttccatggtttgaggctggagcagatcctaatgcaattgctcctttctcatttggctctctcttaggtacccagttgctcctaatggggtgggttgagagcaagagatgggtggacttcttcaacccagattctcagtcagtggagtgggccactccatggtcaaaaactgctgagaactttggcaactctactggtgaacaaggctaccctggaggaaaattctttgaccctttgggatttgctggagctatcaaggatggcgtttacattccggatgccgacaagctagagagactgaaattggctgagattaagcatgctaggattgctatgttggctatgctgattttctactttgaggctggccagggcaagacaccccttggtgctcttggcttgtaa

SEQ ID NO: 3245 - DNA, 1563 bp, Glycine Max
atggcagctgtaaagcctgaggagataagccacccaccaatggaccaacttcaaggcttagagtattgtatagattcaaacccatcttgggctgagacaatagctttgggtttccagcattacattttggccttgggaactgcagtgatgatcccttcatttctggtgcctgtgatgggtggaagtgatgatgataaagtgagggtggtacaaaccctcctttttgttgaaggaattaatacacttttgcagactctctttggaacgagattaccaacggtggtaggaggatcgtatgcgttcatggtccccgttatatctataattcgtgatccttcttttgcaacgatagaggacccacatttgagatttcttagcacaatgagagcagtccaaggagctctaatagtagcttcaagcatacaaataattttgggatttagtcaaatatgggctatttgttctagatttttcagcccacttggaatggttccagtaattgccttagttggttttggattatttgacagaggcttccttgtggtggggacttgcgttgaaattggaattcccatgctaatcctgtttatagccttctctcagattaggtttgaactaataagcttaatattacttgaaaaattttcagataagacaagtacctatactagagagatttgctctactcatatcaacaacagtgatatgggcatatgcacatttgttaacagcaattgcaggacagacagggcaaacctcatttcttctgctccatggataaagattccataccctcttgagtggggtgctcctacatttgatgctggccatgcttttggaatgatggctgctgtgttagtctcattagttgagtcaaccggggcatacaaagctgcatcacgtcttgcaagtgccacaccacctcctgctcacgtgctgagccgtggtatcggttggcagggaattggaatcttgctgaatggccttttcggaacactcactggttctactgtttctgtagagaatgtggggcttctaggaagcaatcgtattggtagtagaagggtcattcaagtttcagctggctttatgatattcttctcaatgttaggaaaatttggagctctatttgcatcaataccattccccatgtttgctgctgtgtattgtgttttgtttggtattgtggcttctgtggggctgtcatttttacagttcactaacatgaactcaatgaggaacctctttatttgtggcgtttccctcttcttaggtttgtccattcctgagtatttcagagaatacactatcagggcctttcatggccctgctcatactaatgctggatggttcaatgatttccttaataccatattcttttcttccccaacggttgcattgattgttgctgtgtttttggacaacactcttgactacaaggatagtgccaaagataggggaatgccatggtgggcaaagtttagaacatttaaaggagatagccgaaatgaagaattctacaccctccctttcaacctcaaccgcttcttccctccatcctaa

SEQ ID NO: 3246 - DNA, 1197 bp, Glycine Max
atggcagcttcttcttctcttttctcctcttcaatgcatatggagatgtttgctccaaagacatcaaagtgtccccaaaattttgtatgctgtcatagcaaaatctcctatatagaacctaattatttaaaaccagtatgctgtcctaattcaagatctttaagtatgaatatgtcatcaaaatgggaacaaacggatcgaagagatgcattgcattgccgcgctttgaaaattgagcctgcaccttccttttcggtggggcagaaatttcaatttgatgatattatagaagctcaacagtttgatagagatattctcagtgccatttttgaagttgcacggaatatggagaacgttgaaaaggattctcctggtagccagattttaaagggttttcttatggccaccctattttatgagccttctactagaactagactttcatttgagtctgccatgagaagactaggcggagaggttttaactactgaaaatgcgagagaattttcgtctgcggctaaaggagagacacttgaagatacaatcagaacaattgagggttactctgatataattgtgatgcgacattttgaaagtggtgctgccagaagagctgcagctatagctgacattccaataatcaatgcaggggatggtcctggacaacatccaactcaggcacttttagatgtctatacaattcaaagagagattggaaagattgacgacataaaagttgggcttgtgggagaccttgctaatggcaggactgttcgttcattggcatacttgcttgctaagttcaaggatgtgaagatttattttgtttctcctgatgtggtaaaaatgaaggatgatataaaagactatttgacatcaaagggagtggaatgggaagaatgtgctgatttagtagaagtggcctcagagtgtgatgtggtttatcaaactcgtattcaaaaagaaagatttggagaaaaaattgacctttatgaaaaggctagaggcaagtacattgtgaatcagggtattctcaatgtgatgcagagacatgctgtggttatgcaccctcttccaagacttgatgaaatcaccttggaagttgatgctgatccaagggcagcttactttagacaagccaaatatggtctatatattcggatggcacttttgaaactcttgcttgttgggtggtag

SEQ ID NO: 3247 - DNA, 1104 bp, Glycine Max; identical to SEQ ID NO: 380

SEQ ID NO: 3248 - DNA, 1248 bp, Glycine Max
atggcaggcgtttctctcaagtgcggtgactgcggtgctctgctgagaaccgtagaagaagcgcaagagcacgctgaactcacctcccactccaacttctccgaatccaccgaaccggttctcaacctcatctgcaccgcttgctccaaaccctgccgatccaaaaccgagagtgatttgcacacgaaaagaaccggccataccgagttcgttgacaagacttccgaggccgttaaaccgattagtttggaggctccgaaggtggatgcaactgcttcatcggaaaacccttccgctgctgcatccactgaccaaaatgaagaaatggttgttcctgaagtggacaaaaagctgcttgaggaacttgaatccatggggttttcaacggcacgggcaacgcgggcgcttcattactctggtaatgctggccttgagtctgccgtaaattggatagtagagcatgagaatgatcctgacatagatcagatgcccttggtacctaccaacaccaaaattgaggctcctaaaccttcgcttaccccagaagaattgaaggccaaacagcaggaactaagggagagagctcgtaagaagaaagaagaggaagagaagagaatggagagggaaagagaaaaggagagaattcgcattggcaaggagttgctggaagcaaagaggattgaagctgacaatgagaggaaacggttgttggccttgagaaaagcagagaaagaggaagagaaaagtgctagggagaaaatcaagcaaaagttggaagaagacaaggcggaaagaaggcggagacttggattgcctccagaggaaccctcagcagccaaaccttcacctgcacctgttgtggaggagaaaaagagttttgtgcctgttaggcctgccacaaaagccgagcaaatgagagagtgcctccgttctctcaagcagaaccacaaggaggatgacgccagagtgaagagagcattccaaactcttctaacttatgtagggaatgttgccagaaatcccgatgaggaaaagttcaggaagatacgtcttagtaaccaatcttttcaggacagagttggttccttgagagggggaattgaatttctagaaaattgtgggtttgagaagatcgatggcggcgagtttttatttttgcctagggacaaaattgagatggccgtcctgaattcagctggatctgaactagactctgcaataaagaatcccttctttggagttctttag

SEQ ID NO: 3249 - DNA, 261 bp, Glycine Max; identical to SEQ ID NO: 381

SEQ ID NO: 3250 - DNA, 195 bp, Glycine Max
atggcaggtgcaagagccagtggcatgatgaatggtggaagaagcttcccaaggaggttctctgggcgtccaattccaaagcgtggacaagtcaaagttggaatagttgtcgggcttgcaaactctgttgtttccattttctctcgcagcagagccacccgaggatgtgctacacctactcacctcgctcactag

SEQ ID NO: 3251 - DNA, 714 bp, Glycine Max; identical to SEQ ID NO: 382

SEQ ID NO: 3252 - DNA, 1083 bp, Glycine Max
atggcagtgggaatgggaagtgagggtatggttttgaccacgttgattttgacgtccggggccagcggccgaatccttggcttcttcaacgccctccttttgctccttctctatctcttccccaccaccaccatgcgcctcgcctcctggaagagtacctccacgtggacgtcgtcgaggagggcgttggccattcggagggtgttggaggatgcagattcagatggaaccacattcagggagtaccatctcttttcaacctcaaggtgtgacaccatttttacccagtcttggattcctcgctctcctagcaataccatcaggggacttgttattcttatgcatggacttaatgaacacagtggcagatatactcatttcgcaaagcacctcaatgctaatggtttcaaggtttacgggatggattggcttggccacggtggaagtgatgggttgcatggttatgtccattctcttgatgatgttgtttctgatacgaaaatatttttggagaaggttcttaacgaaaatcctgggcttccatgtttctgctttggacactcaacaggagcagccattattcttaaggctctgcttgacccaaaggttgaatctcgcatagctggtgctgttttgacatcaccagcagttggtgtttccccttctcatccaattttgctggcacttgctcctatagcttcaattttgctgccaacgtatcaatgtagttctgcatataagaaggggtcaccagtgtctagagacccagaggcgctaattgctaaatattctgatccattagtatgtactggacctcttagagtacgtactggttatgagattctcagaattacaagctacttgcagcgaaatctgagaaaattgagagttccattttttgttctccatggcactgctgattccgtgactgatcccattgcttcacaaaaattatatgtagaagcctcctcatctgacaaaactatcagactatacgatggtttcttacatgacctgctctttgaacccgaacgagatgctatcacacaggacataattcaatggctaaacaatagagtatga

SEQ ID NO: 3253 - DNA, 306 bp, Glycine Max; identical to SEQ ID NO: 383

SEQ ID NO: 3254 - DNA, 1419 bp, Glycine Max
atggcatatgagaatgcaaccctcactgttgctaacagagaggtcatattcatcaaaccttcaaaacccactcctagaaccattctttcactgtctagcattgacaatgatcccgagaacaatatcttcatgcaaaccctttatgtataccaatctccaaattacaattcccctaacactaccaaacttgaccctgcaaaagtgatcaaagaggccctctcaaaggctctcacttactattatcctttagcaggaaaattagtaaaacatgctgatggaaaactcagaatcaactgcaacaccgaaggagttccattcatagaggctatttgtaactgcaacctctcttctcttcgttacctagatggcaacgacgtcgaaatcgcgaaacactttgggatcgattttccttctcaagatgaatttggaaaccaatatcctttggttttcaaggtgattaagtttctctgtgggggtttcatctttgtagtggggtgttcacacgctgtttgtgacggaactgggttatctcagttcttacgagccgtagcagaacttgcaagcggaaaagctgaaccctctgtgaaacctgtgtgggaaagagagagactagtgggaacattcactagtcaacccttgcgaaatcccgaaagctatataagcacttatcatgttcatgaattacccgatgtgggactattcttaacaccaaccacagattattcgcatgaatgctgtaaggtggacggtgagagcatcacaagactcaagatgagtttgatgaaagaaagtgaccatggagaaagtactgagaaaaaagggtacacaacttttgaaaccctagctgcgtacatctggaggtcaagagccagagccttgaaactgagctactatggtgaagctatgctgactatcatagtgggggcgagaccacacttgaaggatcctttgccccttggatattacggaaacaccaccgtggaagcatgcgttacgttaacagtgaaggagctgaacgaaagaccactcttggaggttgtgaaactcatcagaaagaccctaaaggaggttgctttcagcagtgattatatgagacactcgatcaacagtatggaaatgaaaccaatgaagtttaattacgaaagtggtgcaatattgactctgacagatgcgagacatttgggtatgttggagaaggttgatttcgggtggaagcagccagtgaatacaatgccagtcccatgcgacatgtttggaatttcaggtgtttggtcgatcatggctcctagtaatttggatccttcaatgagagctagtggaggagctaaggtttatgtttgcctacctagtgctaccatgcccaagttcaaggaagacatgaaagctcttacacgtatccaaaagagaagttctctatga

SEQ ID NO: 3255 - DNA, 579 bp, Glycine Max; identical to SEQ ID NO: 384

SEQ ID NO: 3256 - DNA, 1572 bp, Glycine Max
atggcatcactggtttcacacttgcgactttcagtactcctattatcagtttcattgggaaattcagcttcactccaagaaaattttgtccaatgtctcaacttgaattcggacagaacattcccatttaacccactaatttacacaccaaaaagtccttcattcaccagtgtccttgactcctccggcaagaatcaaaggcttttggtgccttcaacaccaaaaccaaagttcatattcacaccaacccgtgattcccatgtgcaagcagcggtaatctgctccaagaaacttggcattcatcttagagtgttaagtggtggccatgactttgaaggagtctcgtacgtttcagaaattgaaagccccttcatagttgttgatttgatcaagctccgtgacatcaacgttgatatcaaaagcaacactgcttgggttcaagctggtgccacaaatggtgaattgtattacagaatatatgagaagagttcacttcatggttttcctgcagggacttgcacaagcttaggaattggaggacacatcacaggaggagcatacggaagcatggtaagaaaatatggacttggtgctgacaatgtcttagatgctaaaattgttgatgccaatggaagaattcttgataggaaagccatgggggaagacttattttgggcaataagaggaggtggaggtggaagttttggtatccttctttggtggaaagttaagcttgttcctgttccaccaactgtgacagtttttacagttaaaaagacccttgagcaaggtgcaaccaagcttcttcatagatggcaagaagtggcaccctttctcgatgaaaacctctttatcagagtccgcattcaaagagcacagagtactgtgacaacttcttacgaaggtctcttcctaggtggggcaagaaaactccttaaaatcatgaaaacaagctttcctgagttgggtgtgacaagaaaggattgcatggaaactagctggatcaaatcagtgctctatattgcaggctttccaagtggcacccctcctgaagttctgcttaaaggaaagccaatagctaagttcttcttcaagggcaagtcagattttgtaagaaaaccgataccggaaaccgggctagaggggttgcggcaaaggctgctggtagaagacagccccttgattttatggagcccttatggtggaaggatgaaccaattttcagaatctgacaccccatttccttacagaaatggaactctgttcataagtctgtacatctctctttggcaagagggagagaagaatgttgcaaagcacatagattggattggaaaccttcacaactacatgggggcttatgtgcctagtttcccaagaggacaatatgtgaattaccgggatcttgatttgggaataaacaccaagaacaacacaggcaacattcaggaaagtgcctggggctataggtatttcaagaacaacttcgacaggttggtaaagattaagaccaaagtggatcctcagaacgtcttcaggcatgagcagagtatcccaccacttccaaagtaa

SEQ ID NO: 3257 - DNA, 1350 bp, Glycine Max
atggcatccatgtctcttattcttctttggttcctcttttttgctagtgaaatgatgtcaatgggaaatagtttacacaaggggcacatggtaatggaagaggaggaactgttgggattgtttgaagtgatggatgctcttctggaagacccttactgggcccaagcacatccaaagccatgcactgatactccatggccaggtgttgagtgtgaacttggcagcaataaccaacaaatctttcatgtcaccaaaatccacattggtcctgatatagtcttcccattctcaccttgcaaaccctcagcttatctctcacactccttgctgaaactcaagtatataaaaaccctttcaatttttaactgttttgttgcttcaccagttactctacccaaaactctctttggtcctttctcttcactagaacacttagctttggagaataacccttccctctatggtgaaatacctacaagtttgggaggtgttgctggtcttagggtcctgagcctctcccagaacagcttacaaggaaacatccctagccagattggtggtttggttagtctagagcaacttgaccttagttataacaacttgagtggtcaaatcccaaaggaaattggaggtttgaaaagcatgaccatattggacctaagttgcaatgcagttgaagggtttctgccttgttctcttggaaagcttcaacttctccagaagatggatttgcactctaacagactcagtgaaaacattcctcctgatataggaaacctcaagaggttagtcttgcttgatttgagtcataattttattgtagggcctattagtgaaaccttctcaagtttagaccttttggaatatttactcattgatgacaaccccattaaaggagggataccccagttcatagggaagcttaagaagctcaaatcattgagtttatcagggtgtggattaacaggttctataccctactctttctcttccttgaaaaatcttacagctctctccttaggtaacaatagtcttattggacaagttcctccaaatttgggttcactcccaagcctagatcaactgaatatcagccacaacaagctgagtggggttctagagctacctggtgacttcattcaaaagttaggtaaaagattggatttaagaggaaacagtgaactctgcatcaatgatcagtcaaagaagaagaacctctcttcttacttggaaatcccttcttgtttgaacacacgacagagaaatgatgataattattttgccgcaacccaagttcatgttcatcatggcctaatgatctacatgtcatcatatttaccttggttttaa

SEQ ID NO: 3258 - DNA, 1302 bp, Glycine Max
atggcatccttagatattcattcactgcttttattctctgccattttccgtgttattttgattgtgtatggagagtggcaagatgctcatatggaggttagatacactgatgttgactaccttgtcttttctgatgctgctgctttaatggctgtgggcgattccccttataagagaaccacttatcgctattctcctttgcttgcctttcttctcattccaaattcgttcatccatcgctcctggggaaagtttcttttctcggcttcagatctacttgtgggatatttcatctattatattttaaagctacggaaggttcctgaaaatttgtgcaactattctgtcatgacttggctctttaatccatttaccttcaccattgggacacgtgggaactgtgaacctattgtttgtgctgtggtattgtggattattatttgtcttatgaaaggtaatgtgttacagtcagcattttggtatggacttgttgtccatttcaggatttatcctataatttactctattcctataatcctggttcttgatccgaacttcttcccatctaatcagaaacctgtcctaaggaactggagtgctgttcagggagagagacccaaagatggttgtggccagcatactttacacaatctatttaaaaacatattcacaaggaacagactgatatttggactggtctctggattggttttcctcttttgtactggtcttttcttctgtttatatgagtgggaattcctacacgaggcgctgttgtaccatcttactcgaacagatccaaggcataacttctccatctatttctatcacatatatctccattatgggcaggatacttcagtcgtggaaaagcttatctcctttttgccccaattttttgttcagctggttcttatcttctgctttgcacaagatttgacattttgcctatttgtgcagactgtggcctttgtggcattcaataaggtgattacagcacagtatttcgtttggttcttttgcttgttgcctctaatacttccttggagtaaaatgaaacttagatgggatggattatcttgcattcttgtgtggattggggctcagacccattggttgatgtggggctacctgcttgagttcaagggtaaaaatgtcttcttacagctttgggcggcaggcttactgtttctagcagccaacatatttatcctcgtcatgattattcgtcaccataaatatgcttcagttttcaaagctttagaatatgctaactccaagaatgcagctaagcttgaatga

SEQ ID NO: 3259 - DNA, 2217 bp, Glycine Max; identical to SEQ ID NO: 385

SEQ ID NO: 3260 - DNA, 2088 bp, Glycine Max; identical to SEQ ID NO: 386

SEQ ID NO: 3261 - DNA, 594 bp, Glycine Max; identical to SEQ ID NO: 387

SEQ ID NO: 3262 - DNA, 1272 bp, Glycine Max
atggcatcttcaccggacaccagcaaaaccataaagctgatgcgttacaacagctacctccgcagactcaacagcttcaaactccttaagacatccttcatcctcctcctcctcctctacaccctctccacccaccacctcctcctctcctccgccttccacggccccgcatgggagaatcaggtccgccactccgccctcccccgccgcccccacggcatgtcggtgctggtcaccggcgcggcgggcttcgttggctcccactgctccctctccctgaagaagcgcggcgacggcgtcctcgggctcgacaacttcaactcctactacgacccctccctaaaacgcgcacgccagcacctcctcgccaaacaccaaatcctcatcatcgaagccgacctaaacgacgccccgttgctcgccaagatcttcgacgtcgtttcgttctcccacgtcctccacctcgcagcacaagcgggcgtccgctacgccatgcagaacccccactcctacgtggcatccaacatcgccggattcgtaactcttctagaagcttccaaaaacgctaacccccagcccgccatcgtttgggcctcctcgagttccgtctatgggctcaatgacgaaagcccattctccgaactccaccgtacggaccagcctgcgagcctctacgcggcaactaaaaaagcaggcgaagcaatcgcgcacacctataatcatatctatggactctccctcaccggattgcgcttcttcactgtttatgggccctggggaaggcccgacatggcttactttttcttcactaagtccattctccagagaaagcccattgacgtgtaccagacgcatgacgagagagaagtcgcgcgtgacttcacttacatcgacgacgtcgtcaagggctgcctcggtgccctcgacacggcggagaagagcaccggcggcgtcgtagggaagaagcgcggccccgcgcagctgagagtttacaatctcggtaacacatcgccggtgccggtgggtaaacttgtttccgtgttggagacgttgctcggggtaaaggcgaagaagcacgtgatcaaaatgcctcgaaacggcgacgttccgttcacgcatgctaacgtgagcttggcgtggagggacttggggtacaagcccaccacggatctcgccgctggtctcagaaagttcgtgcagtggtacaaaaggaaaaacacgcagacttggcttgattcatcctttccgtgcccctccattcatttattataa

SEQ ID NO: 3263 - DNA, 315 bp, Glycine Max
atggcattagtgtccggaaacatgaagggtttttaccgacagaaaaaaaccatcgccaccaaaaaatctccgattctctccccggccatcatctccctcggcggaaaacccgacctagaagatgagcacaaggagagcgaggtggtgctgcggcaattcgacctgaacatggcgtacgggccttgcctcgggatgacgaggctcgcacggtgggagcgcgcacagaggctcgacttgaaccctccgcaggaaatcgagaggcttttgaagagtgggaaggttccgaccgagtccttgtgggatggtcgcatttag

SEQ ID NO: 3264 - DNA, 1419 bp, Glycine Max
atggcattcttcagaagcgtttctgcactttctcgacttcgctctcgcgtgggccaacaatctaatctggcgaattcagttagatggctccaaactccgagctccagtaacactgatctttattctgagttgaaggaactggttccagagtatcaggaacgtgttaagaagctgaagaaagatcatggaagtgttgaattaggaaaaatcactgttgatatggtacttggtggaatgagaggaatgacagctttagtatggctaggctcagctgttgacccggatgagggaattcgctttaggggcatgtcaattcctgaatgccagaaaaagcttccaggtgcttttcctggtggggagcctttgcctgaggctgtactgtggcttctattgacaggaaagataccaagcaaagcacaagttgactcattatcccaggaattgcgaagtcgtgcaactatcccagattatgcttataaggcaattgatgcattgcctgtttctgctcatccaatgactcaattcacaactggtgtcatggcccttcaggtgcagagtgagtttcagaaggcatatgagggtgggataactaaggcaaggtactgggagccaacttatgaggatacaatgaatttaattgctcgtttgccagccattgctgcttatatttatcgacggaaatataaggatggaaaaatcataccattggacgattctttggattatggcgcaaactatgctcacatgttagggtttgatgatccggaaatgctggagtttatgaggctgtatatttccatccacagtgatcatgaaggtggcaatgttagttcacacacagcacacctagttgctagcccgctatcagatccttatcttgcatttgcggctgctttgaatgggttagctgggcccctgcatggtctggccaatcaggaggttctacgatggatcagatcaatagttgcagaatttggaactcctaacataagtactgaacaattggctgactacattaataaaacattgagtagaggccaggttgtgcctggatatggacatggggttttacgccagacagatccaagatacacatgtcagagggagtttgctttgaagcatttgcctaatgatccatatttccagttggtgtctaagataaaagaggttgtgcctcccattcttaccaagttaggcaaggttaaaaatccatggcctaatgttgatgctcacagtggagtgctactgaactattatggtctaactgaggaaaactattatactgttctctttggtgtatcaaggagctttggagttggccctcagttgatatgggacagggctcttggaatgccactcgaaaggccgaaaagtgtaacactggagaagctcgagcaattggtcgccaaatcatcctga

SEQ ID NO: 3265 - DNA, 1419 bp, Glycine Max; identical to SEQ ID NO: 3264

SEQ ID NO: 3266 - DNA, 1458 bp, Glycine Max
atggcattgggtagaaacaagactgtccaattagcattgcttctcctctgtttggatctgggaatagcgcatcagcatcagggtcactccccttcccattctggtttctgtgcttccgatgcccataatcactgcggtgatgaccatcatcatgaccatggccatgcgcatgaccataataaggacaagattgatgctaggtcgaagcttcttcccgaagagttagcggaggaggaggatatgaaactctatggcttcggttttccccatcaccatcaccacgatcacgatatcgaggctgcagaactatccggtttaggcctttggttgaatgcattgggctgttcgtttctggtgagcatggcttctcttgtttgtctgattatcctgcctgtaatttttgttcaagggaaaccatcaaaggctgtagttgattcattggctttatttggggcaggagctatgttgggggatgcatttcttcaccaattaccacatgcttttggtggagaacactcccattctcatggtgaccatggagatcatgaccatcatgatagttctggacatgatcatgcacattctttagccgatctttccataggaatatccatccttgctggaattgtactctttcttcttgtggagaagttagtgaggtatgttgaagaaaactcaggaagagctaattcatggacacatggacaccaccaccatcaccacaatagcaaggaaaaattgaaagatgataacagttctactgccaactttcagtcagaatctaataatgcaaaagaagagagattgatagatgagagaaaagaagacgatcaagtgtcacttgactccttgaagggagataatccatctcaatctgaaagctcactcagaaagagaattggaagcaatgtgaccaaaggtgataatctcgacgataatactgtagatagtgccacatataatgtaaaatcttcaaatgttaaggaaccagttagatcaccaacaagtcttgtgtttggttatctcaatcttttctctgatggagtgcataacttcaccgatggaatggctttaggaagtgcattcttgctttatggatctgttggtggctggtctagaactatgtttttgctggcacatgagcttcctcaagagattggtgattttggcattctgataagatctggtttcagcataccaaaagcgttgttcttcaactttctgtcagcactagtggcacttgcggggactgcattggctctgctgtgggggaaagatcctggacagtcatctttgattgagggatttacagcaggtggatttatatacattgcaattgcgggagtacttgcagaaatgaataacggtgggaatacaacattaagaagtactgttgtccaaataatctccctgaccattggcatggctgttgcccttggtatttcccttgtagaatga

SEQ ID NO: 3267 - DNA, 2091 bp, Glycine Max
atggcatttctccaacgcccaattccaaagcccttgtttcactttttccaatccgatatggccgccgcgaccgccttgctccgctctctccgccgccgcgaccttccctcgtcttctctctccgcctttcgttcgttgacgagtggcacaaagacatcatatgtagggaacaagtgggcaagtttgtctcggccgttcagttcaaagcctgctggtaatgatgtcattggaattgatctgggtactaccaattcatgtgtttctgttatggagggaaagaatcccaaagttattgagaattctgaaggagctcgaacaacaccatcagtggttgccttcaaccagaaagcggagcttcttgttggtacaccagccaagcgtcaggctgtgacaaacccaacaaacactctttttggaaccaagcgtttgataggtaggcgttttgatgattctcaaactcagaaggagatgaaaatggttccatacaagattgttaaggctcccaatggagatgcttgggttgaagccaatgggcagcagtattctcccagccaagttggtgcttttgttctcaccaagatgaaggaaactgctgagtcatatcttggaaagtcagtttcaaaagctgtaattactgtaccagcttacttcaatgatgctcagagacaggcaacaaaagatgccggtagaattgctggtcttgatgttcaaagaatcatcaatgagcccactgctgctgcactttcatatgggatgaacaacaaggagggtctcattgcagtttttgatcttggaggtggaacatttgatgtgtccatcttagagatttctaatggtgtttttgaggtgaaagccacaaatggtgacacgttcttgggaggagaggattttgataatgctttattggattttctagtgaatgaattcaaaagaactgagaatattgatctttcaaaggataaacttgcattgcagaggcttcgagaagctgctgagaaagcaaaaatagaactgtcttcaacatctcaaacagaaatcaatcttcctttcatcactgctgatgcatctggtgcaaagcatctgaatatcacattgactagatctaagtttgaggctttggtaaaccacttgattgaaaggacaaaggcaccgtgtaagagctgtttgaaggatgctaatgtatccatcaaggaagttgatgaggttcttcttgttggagggatgacccgggtgcctaaagtccaggaggtggtttcagcgatctttggaaagagtcctagcaaaggagtaaatcctgatgaggcagttgccatgggagcagctattcagggtggtatcctacgtggagatgttaaagagctactactcctagatgtcactccactttctctgggtattgagactttgggtggtatctttaccaggttgattaaccgcaacaccacaattcctactaaaaagagtcaggtgttttcaacagcagctgacaatcagactcaggttggtatcaaggtgctacaaggtgagagggagatggctgtagacaacaaatcgcttggagaatttgagcttgttggcattcctcctgccccaagaggcatgcctcagattgaagtcacatttgatatagatgccaatgggattgttactgtctctgccaaagacaagtccactgggaaagaacaacaaatcaccatccgttcatctggaggactctcagaagatgagattgataagatggtcaaagaagcagagttgcatgctcagaaagaccaagaaagaaaggctctcattgacatcagaaacagtgcagatacaaccatctacagcatcgagaagagtttaggtgagtacagagataagatccccagtgaagtggccaaagagattgaagatgcagtatcagatttgagaacagcaatggcaggagacaatgctgatgaaattaaggcaaagcttgacgctgcaaacaaagctgtctccaagattggagagcacatgtcaggtggttctagtggcagttcctcagctggaggttctcagggtggtgaacaggctcccgaggcagagtatgaggaagtcaagaaatga

SEQ ID NO: 3268 - DNA, 885 bp, Glycine Max
atggcatttggactcaggacaaagagctttgggttcatagaaggagaggctcatgagtttgtgggtgcacttcaatggtggaaccagattgatgactcagatcaatggcagagaggcacttactatgccctttgtgccgcttatacgttggtctcctttgttgccctggtgcaactggtacgaattcaaaggagggtacctgagtatgggtggacaacgcagaaggttttccatttgatgaattttgttgtcaatggatgtaaggctgtccttttcggtttttacagaagtgtttttgcaattagaccaaaggcactagagcaggtgctaatggaggttcctggtcttctgtttttttctacttatacattacttgtcttgttctgggctgagatatatcaccaggccagaagtgaaccggcacagaaacttaggccatcttattttattatcaatggttttatttacttgatacaggtctgcctctggatttacatgagtgtaagcaaaactgcagctggtttggaagctgcaaaactcctccttgcagttatatcattctttgcggctcttgcatttttattgtatggtggaaggttgtttttcttgttgagacgctttcccatagaatccagaggccgtcaaaagaaactttacgaggttggatctgttacaagtatttgttgcacttgtttcctgataagatgtgctttgcttgcactttctgcatttgatgagaattcagatcttgatgtcttggaccatcccattcttaacctaatgtactatttgttggtagagattgttccatcagcgctggtgctcttcatattgcgtaagctgcccccgaggcgagtttctgatcagtaccaccccattaaatga

SEQ ID NO: 3269 - DNA, 885 bp, Glycine Max
atggcatttggactcaggacaaagagctttgggttcatagaaggagaggctcatgagtttgtgggtgcacttcaatggtggaaccagattgatgactcagatcaatggcagagaggcacttactatgccctttgtgccgcttatacgttggtctcctttgttgccctggtgcaactggtacgaattcaaaggagggtacctgagtatgggtggacaacgcagaaggttttccatttgatgaattttgttgtcaatggattgagggctgtccttttcggtttttacagaagtgtttttgcaattagaccaaaggcactagagcaggtgctaatggaggttcctggtcttctgtttttttctacttatacattacttgtcttgttctgggctgagatatatcaccaggccagaagtgaaccggcacagaaacttaggccatcttattttattatcaatggttttatttacttgatacaggtctgcctctggatttacatgagtgtaagcaaaactgcagctggtttggaagctgcaaaactcctccttgcagttatatcattctttgcggctcttgcatttttattgtatggtggaaggttgtttttcttgttgagacgctttcccatagaatccagaggccgtcaaaagaaactttacgaggttggatctgttacaagtatttgttgcacttgtttcctgataagatgtgctttgcttgcactttctgcatttgatgagaattcagatcttgatgtcttggaccatcccattcttaacctaatgtactatttgttggtagagattgttccatcagcgctggtgctcttcatattgcgtaagctgcccccgaggcgagtttctgatcagtaccaccccattaaatga

SEQ ID NO: 3270 - DNA, 504 bp, Glycine Max
atggccaaaaactatgggttccttgtctgcatttttgtcttggtcttggacattgtagctggcatacttggaattcaagcagaaatggctcaaaacaaggttaaggacttgaaagtgtgggtacttgagtgtagggatccaagctatgaagctttcaagctaggacttgctgcttccatttgcttggtctttgctcatgcaattgctcacttgcttggtcggtgcatttgcatgcaatccaaagaagaatgccaaggagccacagctaatgggcgattagcagtggcttttctcattttatcttggatattattagggattgctttctccttgctgatttttggctccttagccaactcaagatcaagggaatcgtgtgggatatcaaatcgtcggtttctatccattggagggattctatgcttcatacacgggttgttcaccattggttattatgtttctgtaactgccacaagaagggaagaaaagaggcaaggaaactcc

SEQ ID NO: 3271 - DNA, 450 bp, Glycine Max
atggccaaatcaatggaagcatacgtttctgatatccaatatattaacacctggaagacatcacaaggacaaaagggggatatggtccaaactgcaatacctgatgtgaatttgcgaagattaagaacagagaactcctcagctagatcaggtctgctccaacgcctagagcaccctgttaaagctgatggctcacttagccttgtggtcattggagaccggggaaggaaaggaacatacaaccaatctcaagttgccactcaggtcttcatcctctatttagtgggaacttgtgttccagtattagtctaccaaatccagttcttaaccagtggtggaggttcaaaggcatggaaaggagacatggataaagataagacagatgggatcaagttttattatgatggacaaggatttatgtccgcggagctggaagaaaccaatgtcaaa

SEQ ID NO: 3272 - DNA, 2298 bp, Glycine Max
atggccaacaaagtccatgttttgttgtgtgtccttgtgacaacgttgttgagttgtgatgttgttgttgttgtttggggccagacattcgcttgtgatgttgggaagagccctgcagtggcaggttatggtttctgtgacaagtctttgggagtggaagcaagggtgaaagaccttgttgggaggttgacattgcaagagaagatagggaacttggtgaactctgctgtggatgtgagtaggcttgggattccaaagtatgaatggtggtccgaagcacttcatggagtgtccaacgttggccccgggacgcgattctccaacgtgattcctggtgcaaccagctttcccatgcctattctcactgctgcttctttcaacacttcgttgtttgaagtcattggaagggtggtgtcaacggaagcaagagcaatgtacaatgttggccttgctggtttgacatattggtcaccaaacattaacatattcagagatccaagatggggaagaggtcttgaaacgccaggggaagaccctgtgctcactagcaaatatgcagcaggctatgtcaaaggtcttcaacaaactgatggtggagaccccaacaagctcaaggttgcagcttgttgcaaacactatacagcctatgatgtggataattggaaaggaattcagcgttacaccttcaatgccgtggtgactaagcaagatatggaggacacattccaaccaccattcaagagctgtgtgattgatggcaatgttgccagtgtcatgtgttcctacaacaaggttaatggaaagccaacttgtgcagaccctgacctcctaaagggtgttgtccgtggtgaatggaaactaaatggatatatagtttctgactgtgactcggtagaagtgctttacaaagatcagcactacaccaagactcctgaagaagctgcagccatatccattctggcagggttggatttgaactgtggaagatttcttggccaatacacagaaggtgctgtcaagcaagggcttatagatgaagcatccattaacaatgctgtcaccaacaacttcgccacgttgatgcgtctaggattctttgatggtgatccaagaaagcaaccttatggaaaccttggtccaaaagatgtctgcactcaagaaaaccaggaacttgcccgagaagctgcaaggcaagggattgtgttgctgaaaaatagtccagcatcactgcctctcaatgccaaagccattaaatcgttggcagttattggacccaatgctaatgctactagggtcatgattggaaactatgaaggcatcccatgtaagtatatatcacccttgcaaggcctaacagcctttgctccaacaagttatgctgctggctgtcttgatgtgcgctgccccaatccagtactagatgatgccaaaaagattgctgcctctgctgatgccacggtgattgtagtcggtgcaagtctagcaattgaggcagaaagtctagacagagtcaacattcttcttccaggacagcaacaacttctagtctctgaagttgcaaatgcatccaagggacctgtgattcttgtcataatgtctggaggaggcatggatgtgtcctttgctaaaaataacaataaaatcacaagcattttgtgggttggctaccccggagaagctggtggagctgccatagctgatgtgatctttgggtttcacaatccaagtggaaggctacctatgacatggtatccacaatcatatgtagacaaagtgccaatgaccaacatgaacatgaggccagatcctgccacaggttaccctggtagaacatacaggttttacaaaggggaaactgttttcgcatttggagatggattaagctactccagtatcgtgcataagttagttaaagcgcctcaattggtgtcagttcaactagctgaggatcatgtgtgccgttcctcagaatgcaagtcaattgatgttgttggtgaacattgtcaaaacttggtgtttgatattcaccttaggatcaagaacaaggggaaaatgagcagtgctcatacagtgtttttgttctctactcctcctgcagtgcacaatgcaccacagaaacacttgctgggttttgagaaagttcacctgataggaaaatcagaagcactggttagtttcaaagtagatgtttgtaaagatttgagtatagttgacgaacttggcaacagaaaagttgccttaggacagcatctgcttcatgtgggggacttgaagcatcctttgagtgtgatgatttga

SEQ ID NO: 3273 - DNA, 2217 bp, Glycine Max
atggccaacaaagtccatgttttgttgtgtgtccttgtgacaacgttgttgagttgtgatgttgttgttgttgtttggggccagacattcgcttgtgatgttgggaagagccctgcagtggcaggttatggtttctgtgacaagtctttgggagtggaagcaagggtgaaagaccttgttgggaggttgacattgcaagagaagatagggaacttggtgaactctgctgtggatgtgagtaggcttgggattccaaagtatgaatggtggtccgaagcacttcatggagtgtccaacgttggccccgggacgcgattctccaacgtgattcctggtgcaaccagctttcccatgcctattctcactgctgcttctttcaacacttcgttgtttgaagtcattggaagggtggtgtcaacggaagcaagagcaatgtacaatgttggccttgctggtttgacatattggtcaccaaacattaacatattcagagatccaagatggggaagaggtcttgaaacgccaggggaagaccctgtgctcactagcaaatatgcagcaggctatgtcaaaggtcttcaacaaactgatggtggagaccccaacaagctcaaggttgcagcttgttgcaaacactatacagcctatgatgtggataattggaaaggaattcagcgttacaccttcaatgccgtggtgactaagcaagatatggaggacacattccaaccaccattcaagagctgtgtgattgatggcaatgttgccagtgtcatgtgttcctacaacaaggttaatggaaagccaacttgtgcagaccctgacctcctaaagggtgttgtccgtggtgaatggaaactaaatggatatatagtttctgactgtgactcggtagaagtgctttacaaagatcagcactacaccaagactcctgaagaagctgcagccatatccattctggcagggttggatttgaactgtggaagatttcttggccaatacacagaaggtgctgtcaagcaagggcttatagatgaagcatccattaacaatgctgtcaccaacaacttcgccacgttgatgcgtctaggattctttgatggtgatccaagaaagcaaccttatggaaaccttggtccaaaagatgtctgcactcaagaaaaccaggaacttgcccgagaagctgcaaggcaagggattgtgttgctgaaaaatagtccagcatcactgcctctcaatgccaaagccattaaatcgttggcagttattggacccaatgctaatgctactagggtcatgattggaaactatgaaggcatcccatgtaagtatatatcacccttgcaaggcctaacagcctttgctccaacaagttatgctgctggctgtcttgatgtgcgctgccccaatccagtactagatgatgccaaaaagattgctgcctctgctgatgccacggtgattgtagtcggtgcaagtctagcaattgaggcagaaagtctagacagagtcaacattcttcttccaggacagcaacaacttctagtctctgaagttgcaaatgcatccaagggacctgtgattcttgtcataatgtctggaggaggcatggatgtgtcctttgctaaaaataacaataaaatcacaagcattttgtgggttggctaccccggagaagctggtggagctgccatagctgatgtgatctttgggtttcacaatccaagtggaaggctacctatgacatggtatccacaatcatatgtagacaaagtgccaatgaccaacatgaacatgaggccagatcctgccacaggttaccctggtagaacatacaggttttacaaaggggaaactgttttcgcatttggagatggattaagctactccagtatcgtgcataagttagttaaagcgcctcaattggtgtcagttcaactagctgaggatcatgtgtgccgttcctcagaatgcaagtcaattgatgttgttggtgaacattgtcaaaacttggtgtttgatattcaccttaggatcaagaacaaggggaaaatgagcagtgctcatacagtgtttttgttctctactcctcctgcagtgcacaatgcaccacagaaacacttgctgggttttgagaaagttcacctgataggaaaatcagaagcactggttagtttcaaagtagatgtttgtaaagatttgagtatattgccttag

SEQ ID NO: 3274 - DNA, 306 bp, Glycine Max
atggccaacaatccgtcacagcttctcccatcagagttgattgaccggtgtataggttcgaaaatttgggtgataatgaagggtgacaaggagcttgttggtactcttagaggctttgatgtttatgtcaacatggtccttgaagatgttactgaatatgagatcactgctgaagggagacggataaccaagcttgatcagattttactcaatggaaacaacattgccattttgttcctcgcaagtgttatactgatactagcaattatctggcttcatgcagttggtccctggtggttctcctga

SEQ ID NO: 3275 - DNA, 393 bp, Glycine Max
atggccaacagagttcaaattcctaccaacaattcagccctcattgctatgattgcagatgaggatactgtagttggatttctgttggctggagtgggaaatgttgacatacgtaggaagacaaattacctcattgtggattcaaaaacaactgtcaaacaaattgaggatgcattcaaagaatttacaacaagggaggatgttgcaattgtgctgattagccaatatgttgcaaatatgataaggtttttggttgatagctataacaagcctgttcctgcaatacttgaaatcccttctaaagaccatccttatgatccagcacatgattcagttctgtcacgagtgaagtatctcttcaataccgaatcagttgcatctgggagacgctga

SEQ ID NO: 3276 - DNA, 693 bp, Glycine Max
atggccaaccttggaggtagaactaataatggaatttcaacaaaccatgttgagatccctatccatatttcaaatggtgtagagctaaaaccaatccaagaggttgcacttgcagagagtagtagcattattgactactctcaaagggcccagtggcttcgagctgcagtgttaggagctaatgatgggttggtttctgttgcttcactgatgatgggtgttggagctgttaagaaagacatcagtgccatgcttcttgctggttttgcaggattagttgctggggcttgtagcatggcaattggagagtttgtctctgtgtacactcagtatgacatagagatgactcagattaaaagagagagggaagcaaataacaatagaggagttaatgaagaaactcaaagggagaagcttccaaatccatttcaggctgcactagcatcagcactggcattttctgttggtgctttggtgccactgatagctgctgtgtttataaggaatcacaagattagaatgggagttgttgctgctgcggttagcttggcattgttggtgtttggaggagtaggagcagttcttggaaaaactccggtgacgaggtcttgtcttagggttctggttggaggttggatggctatggccataacatttggcctcaccaaattgattggctctgctgatctttga

SEQ ID NO: 3277 - DNA, 1017 bp, Glycine Max
atggccaatatcaagcaaatcggaaagaagcaggcttgtgtgatcggtggcagtggatttattgcttctttgttgatcaagcagttgcttcagaagggttatgctgttaataccactgttagagatttaggtagtatcaataaaatagctcaccttttggtactgaaaaatctgggcgaattgaaaatatttagagcagatttgacagttgaaggagattttgaagcccctatatcaggctgtgaacttgtattccaatttgctacacctatgaactttggttctgaagatcctgagaatgacatgatcaagccagcaatcagcggcgtattgaatgtgctgaaaacatgtgctcaaacgaaagaagtcaaacgagtcatcttgacatcttcaactgatgctgtaactattaaccaactcaatggaaaaggtcatgttatggatgaaagcaattggactgatgtggagtacttgaccactgcaaagccacatggatggggatatcctgcctccaaaacactagcagagaaggctgcatggaaatttgctgaagaaaatcacattgatctcatcactgtgataccttccctcactgctggtccttctatcactgcagacatcccattcagtgttgtgttggctgcgtccctaatgaaagggaatgatttctacattaagtctttgagagagatgcaattgctgtcaggttcaatatctatcactcatgttgaggatatttgccgagcacatatatttgtggcagagaaagaatcagcttctggtcgatacattgtctgtgctcacaatactagtgttcctgagcttgcaaagtttcttagcgaaagataccctcgatatgaaattccaactgaattccatgatatcccctccaaggcaaagttagtcatctcttcagagaagcttatcaaagaagggttcagtttcaagtatggcattgaagaaattattaaccagagtgtggagtacttaaggagtgagggggccctgctcaactaa

SEQ ID NO: 3278 - DNA, 741 bp, Glycine Max
atggccacaaccaccatgttctcatcaccatcggcaattctctcctcagccgccacaaccaccaccccaaaaccatcctctgcagcaccacactccccatcatgcaagcatcctcttctactacccttcaaacagcccttaacaaccttaactgccgccgccgccatcgccactattttaacctccgctccaacaccctccttagcacaagagtccctctcatataaagtctactatggcaccgccgccagcgccgcgaactacggcgggtatggtggcaactccagcaagaaggactctgctgagtatgtctacgacgtgcctgctggctggaaggaacggttggtgtctaaagtcgagaagggtaccaatggaacggacagtgagttttataacccaagaaagaaggcagagaaagagtacctcacttttctcgccgggtttcgccaacttgcgccaaaggatgtgattttgaacaacttggcactgtctgatgtggacctgcaggacctgattggcaatgctgacagtgtgacctctgaggaggtgaaggatgataaggggcagctgtactatgtgtatgagattgatggtgttggcactcatagcttgatctcagtgacttgtgctaagaacaagctctatgcacattttgtcaatgctcctactcctgagtggaacagagataaggacgtgttgaggcatgttcatgagtcttttaagactgtggggtctttttag

SEQ ID NO: 3279 - DNA, 366 bp, Glycine Max
atggccacatctctctctgcacgccaaatcaagcccacccagaacccaattccgttttcccaatcggagatcgaagccgcgaagcaactcatccaactcagcagcggagattctgaggaagatcaccacagcagcagcaacagctgcagctacagcgtggtgcaagggaaaccaccccaacagagcaaggttgattccggcggcgatgtttcgtccgtcgcagttaccactgcggtggagtccgaagatgaaagctttgcgagaaagaataagaggtatcgttgtattaaagatttgtatagcgctacaactcctgtggtgaaagcgaagaggaagaggaacaagtgtgtcggaactaggaagtga

SEQ ID NO: 3280 - DNA, 693 bp, Glycine Max
atggccaccaacgaggagagggatatggagaacaagaagagtgaggaagaactgaagcatctcgggtttgtgaagattgcggcaatgaaagccttagtgtgtgtgtcgaatctctacggcttcgcaaagcaaaactcgggacttttgagatctgctgttggaaccgtggaagacactgtaaccaccgttctgggtcccgtctaccacaaattcaacgctgttcccaaccacatcctcctttttgtcgacaacaaggtggatgaagctgctcacaaattcgatgagcatgcaccttctttggccaagcaggttgcaagccaagtcacttgtttggttcaggaagtgacacacaaagctgagaaagtagtgagtgaagctcaatctggaggggcacgagcagcagcaaattatgtagccactgagtccaagcaaattgtgctctttggttcagtgaaattgtggactggtctcaaccactatccaccattccatgcagtggctgagatggcagttcccacagctgcacactggtcagaaaaatacaacaatgtggtcaagggaacaagtgagaagggttatgccgtgtttgactatttgcctctgattccaattgatgacattgctaaggcgtttaaacacggagaaggcaatgtgaatgaagatgaagcatgttccgtgggagactgttcttag

SEQ ID NO: 3281 - DNA, 435 bp, Glycine Max; identical to SEQ ID NO: 388

SEQ ID NO: 3282 - DNA, 948 bp, Glycine Max
atggccaccttgaatgttccccctcttcctccttcaccgagagacgatgccatacaactttacgctgctttcaaaggatttggatgcgatactagcgttgtgatcaatatacttgctcatcgagatgctacccagcgtgcctacatccaacaagaatacaaagcaatgtattctggggatcttctcaaacgcttatcttcagagctttctggcaagttggagactgcactactgctttggatgcacgaccctgccggacgtgatgcaatcatccttaggcagtctctaaccctgcccaaaaatcttgaagctgccactcaacttatatgttctcgaactccatcccagcttcattatttaagacagatttatcattctaaatttggtgtttatcttgagcatgacattgaaacaaacacctccggggatcataaaaagattttgcttgcatatgtaaccacaccacgtcatgaaggccctgaggtaaatagagagatggctgagaaggatgcaaaggttctctacaaagcaggggagaagagactgggaaccgatgagaagacttttgtgcaaatattcagcgaacggagtgcggctcatttggctgctataacttcttattaccatagcatgtatggacactcgttgaaaaaggcagtaaagaaggaaacatcaggaaattttgctcttgcacttctgacaatagttcaatgtgctgagaatcctgcaaagtattttgccaaggtcttacgcaaggcaatgaaaggtttggggactgatgacacaaaacttataagggtgatagtaacaagggctgagattgatttacagtatatcaaagctgaatatttaaagaaatacaaaaagacgcttaacgatgcagttcactcagaaacatccggccactacagggcttttcttctctcactcttaggtcccaaccagtag

SEQ ID NO: 3283 - DNA, 543 bp, Glycine Max
atggccacgaatccaatcgaagcggggaacggcgacgctgctcccaaccctaacgcgactaccaaatcctccgtgtacctgcaagactcggaggagctgaagcgagtcttcagccgcttcgacgccaacggcgacggcaagatctccgtctcggagttggacaacgtcctccgctccctcggatccggcgtcccgccggaggagctccagcgtgtcatggaagaccttgacaccgatcacgacggcttcattaacctctcggagttcgccgccttctgccgctccgacaccgcggacggcggcgacaccgagctccacgatgccttcaacctgtacgatcaggacaagaacggcctcatatccgccacggagctctgccaggtgctgaaccgcctcggaatgaagtgctccgtggaggaatgccacaacatgatcaaatccgtggattccgacggcgacggcaacgtcaacttccccgagttcaagcggatgatgagcaacaatcgcgaaaatgctagcaatgctgaagaaaaaacagattag

SEQ ID NO: 3284 - DNA, 1014 bp, Glycine Max
atggccactatcaagccaactggaaagaaggcatgtgtgattggagggagtggatttatggcctctttgttgatcaagcagttgcttgaaaagggttatgctgtcaataccacagttagagacccagataatactaaaaaaatacctcaccttttggcactgcaaagtttgggcgaattgaacatatttggagcagatttaactggtgaaaaagattttgatgctcctatagcaggctgtgaacttgtcttccagcttgctacacctgtgaactttgcttctgaagatcctgagaatgacatgatcaagcctgcaatcacaggcgtcttgaatgtgttaaaagcatgtgtgcgagcaaaaggagtcaaacgagtcatcttgacatcttcagcagctgctgtgaccataaaccaactcaagggaactgatctggttatggatgaaagcaactggactgatgttgagtacttgagcactgcaaagccacccacttggggttatcctgcctccaaagcactagcagagaaggcagcatggaaatttgctgaagaaaatcacattgatctcatcactgtgatacctactctcacaactggtccttctgtcactacagacatcccatcaagtgttggcatggcagggtccctcataacaggcaatgatttcctcataaacgctctgaaaggtatgcagttgctatcaggttcaatatccatcactcatgtggaggatatttgccgagcacaaatatttgtggcggagaaagaatcggcttctggtcgatacatttgctgtgctcacaatactagtgttcctgagcttgcaaagtttctcagcaaacgataccctcaatataaaattccaactgaattcgatgattgtccctcaaaggcaaagttaataatctcttccgaaaagcttgtcaaagaaggattcagtttcaagtatggaattgaagaaatttatgatcagactctggagtacttaaagagcaaaggggctctgaataactga

SEQ ID NO: 3285 - DNA, 2124 bp, Glycine Max; identical to SEQ ID NO: 389

SEQ ID NO: 3286 - DNA, 2037 bp, Glycine Max; identical to SEQ ID NO: 390

SEQ ID NO: 3287 - DNA, 735 bp, Glycine Max; identical to SEQ ID NO: 391

SEQ ID NO: 3288 - DNA, 762 bp, Glycine Max
atggccatgatgggctcaatgctgctcagtctcagaccctttctcaccaccatcttctttctcacactcacagtgctcaaggtttcagcatcatcctcagtgattttctacaacaagtgccagcacccagtgtggcccgggatccagcccagcgcaggaaagcccgttctggcccgcggaggcttcaagctcgccccaaaccgggcctactccctccagctccccgctctatggtccgggcgcttctggggccgccacggctgttccttcgacgccggcggccgggggcgctgcgccaccggggactgcggcgggtccctgttctgcaacggcatcggcggaagcccaccggcgaccctggcggagttcaccctgggcaacgagcaggacttctacgacgtgagcctggtggacgggtacaacctacccatctccatcacccccttcaagggatccggaaaatgcagctacgccgggtgcgtgagcgacctcaacaccatgtgccccgttggcctccaagtgcgctcacgcgacaacaagcgcgtggtggcctgcaagagcgcttgctccgctttcaactcccccaggtactgctgcacgggctcctatggaagcccacaggcctgcaagcccaccgtctattccaagatcttcaagaccgcatgccccaaggcctactcctatgcctatgatgaccccaccagcatcgctacttgcaccaaagctaactatttggtcaccttctgcccccatcgccgctag

SEQ ID NO: 3289 - DNA, 1248 bp, Glycine Max; identical to SEQ ID NO: 392

SEQ ID NO: 3290 - DNA, 1218 bp, Glycine Max
atggccgacgatccaatgcccacgcgctggtctttccaggacttcaaattgtgttatgatgctaagtttggtagaaagaaagtcgcggagaacggagatgatgctgccggtaaagcggtcagcaatggaaatggaaattcagtgacagtggccattgtgtccaatggcaacaaaagggcatcggaaatggctgtttatgagcagtttcgaagcgaggggcagaatcagattcacacaaatggctttgtgccgacccttacagatgaaaggccgcagaagtctttgcttccaccctttgaatctgcggaaatgcgagctttagcagagagcttaagtagggatatcattcgtggaagtccagatgtgaagtgggaaagcatcaaggggttagagaatgccaaacgtttactgaaagaggctgttgtgatgccgattaagtatcccaagtacttcactggtctgttatcaccatggaagggtatcctcctttttggcccaccggggacaggaaagacaatgcttgcaaaggcagttgcgacagagtgcaatacaactttttttaatatttcagcctcatctgtagtcagcaaatggcgaggtgattcagagaagttagtgaaagtgttatttgaacttgcaaggcatcatgcaccctcaacaatatttcttgacgaaattgatgcaatcattagtcaacgtggtgaagctcgcagtgaacacgaagctagtagacggttgaaaacagagcttctcattcagatggatggtttgacaaagacagatgaactggtttttgttttagcggcaacaaatcttccctgggaactggatgcagccatgcttcgacgtcttgagaagcgaatccttgtaccacttccagaaccagttgcgagaagagcaatgttcgaggaactccttcctcaacagcctggcgaggaatcgatcccctatgatatactggaggataagacagaaggatattcgggatcggatatccgattactctgtaaagagacagcaatgcaacccttaagacgcttaatgtcacaacttgagcagaaccaggatgtggtgcctgaagaagagttgccaaaagttgggccaatcagatctgaagatatagagacagctttgagaaacacaaggccatctgctcatctccatgcccacaaatatgacaagttcaatgctgattatggtagtcaaatactacaatga

SEQ ID NO: 3291 - DNA, 2361 bp, Glycine Max
atggccgataacgatcactcccactcccaccctcaccaccaccaccaccaccaccgtcctcatcgcctctcagtgccgccgcgcagcaccacattcggcggcactccgggaacccagcccgccttctggtactcctcaagcacaaccccaaccccaaccccctccaaaacccgccgttcattgtccttcccgaaatcgaaatcgaaatcgagatcctcagtcttcctcctcctcttcttctccctccgctccctctactccctccttcccttcctccgctcctctccttccttctccctcttccccttctccttcctcgtctccctcctctccttctccctcaccctctccttctccctcttctcttcttcctccacctcctccaaagacccctttctccaccacaaacccaaacaccctcttctctcaccttccctcacaccctcccagcagagaatcttggtcaccaaatcaatcctccttgccctcgtcttcctcctccgcttccaggccctccgctactgcggcaccgcctccatgatcctcgccgagttaatgggctccatcgctgcccggcccagaaacccttacaggcacaacctccgcggcttcctctccctctccctcggcctcctcctgctctccttcggctgggaccggatcgaatgcttcccgttctctcccgcttgcctcacccgccggatttggcccttgatcctccctttcgcctccggctttctcgcccactaccggctcgtggactccgggactactctcaaacagctcggccgcaaacgggttcggttaattactctccttttcactactgttattctatttgttcccgcagttgttagtttcttcgtgtttgaggcagaagaagatagtgttgcctttgggaatttggcgtggccattggtgaatactgttgttttcggtgtgcttttgagtgagagttatagtggtgatgataatgatgatgatgatagtttcgcgagttcgagggagtttctggttacttttgtttgcactttggtgttggagcttttttatttccctgaactttccctctggggtttgttgctttgtggtttgttgctatatgttggtgttagagacttggatccttttcattcttccaatgaaggggagttctcgggtgacatgattatgaagcctatcagacatgttttgagcgagaggaagtcgcggaagattgcgctttttcttctaatcaatgctgggtatatggttgtggagtttgctgctgggttcatgagcaatagtcttggcctgatatcggatgcgtgccacatgttgtttgattgtgctgctttggccattgggttgtatgcatcgtatatatctcgtttgccggcaaataatcactataactatggtagaggaagatttgaggttttatcagggtatactaatgctgtgtttctggttcttgtgggagcactcatagtggtggagtcctttgagaggatattggatcctcaggagatatcaactaatagcttgttggttgtctccataggagggcttgtggtcaatgtcattggcttgatattctttcatgaggagcatcatcatgctcatggccatgtattatctggatcatcatgctcccattcgcacacacacacggagtcgcatagtcaccacacccaccatcatcatgatcatgatcatgatcatgatcatctgcatagccatgacgattcatgccctggtgatcatggccatcatcataatcataaccactgtagtcatgagaggaagcatcatggtgagtgtcatgatcatgaagacaaacacagcattccgagctttaagcatcatgatgctgccgcccactgccatgaccatggtgaacatcatgatcaaactgggcactcttgtcatgaagatgctccacttgttcgtaaagagcatgaccatcgccatattgatcacaatatggaagggatatttttgcatgttcttgctgacaccatggggagtgttggtgttgttatatctaccctgttgattaagtacaagggatggcttattgctgatcctgcctgctcaatttttatttctattttaattgtatcttctgtgatacctttgctaaaaaattcagcagaacatgagctgaaggatgccttaattaatgtttcgaagataaggggtgtttatggcattcaaaagtttcattcctggaacttcacaaacacagatgtagttggtacgatgcatcttcacgtgtcaacagatacagacaagacatccgccaagtcgcaggttttgcatctgttacgtaatgctggaatcaaggatgtaaccttgcaggtggaatgtgttggataa

SEQ ID NO: 3292 - DNA, 1875 bp, Glycine Max
atggccgatccaaactccaatcctaaccactctaacgctcacgtgaaccgttccagacactacaccactcacgtgaccttccgtctcctctgtcacgcgtcgcgcgtgggcgccatcatcggcaagtccggcgtgctcatcaagtcgctccaggaggccaccggcgccaagatacggatcgtggacgcgccgccggactcccctgaccgagtcatcctcgttagcgccccctccgtcaccgaagacggtgagctctccacggcgcaggaggcgctgctcaaggtcttcgaccgggttctcgacgtcgccgccggcaccgaagtcggcgacctcgtggtctcttgccggcttctggccgaaacttcgcaggtcggcgccgtcatcggcaaggccgggaaggtcgtggagaagatcaggatggacaccggatgtaagattagggttttgaatgaaggtttgccggccggcactgctccctccgatgaaatcgttgagagggcgagccctggtgcagcggtaaagttgtgccttggtgacttgttggtcatgggttcgaatccggaaacagcctctttgcatatgcaaggaaaggattgtttggagttgtatcagatagaaggccagctgacatctgtaaagaaggcactcattgctgtctctcatcggcttcaagattgtcctcctcctgatagaacaaagatgacaggaagcagacattatgaagtggttcagtctgagacattttcagttccacttgagtctttaactaatctgcatatagatcatcatctgcaaaggagctctacattatccactttatccaataggtctaatggcaatgcctctggagctcataaattatcagctgaagttaatagagtctcagccctggatccaaaagcatatcagcaggaagttacctttagaattatttgttccaatgatagggttggtgccgtaattggaaaaggtggcagtattgtaagagctcttcagaacgaatcaggggctattataagtgttggtccttcattagttgagtgcgaggatcgactagttactattactgcttcagagaatcctgaatcaacatattcccctgcacagaaggctgttgtgcttgttttctccaagtctgttgaggctggtgttgagaaggggctagagttgggatcaaaaaaggagccatatgttactgcacgacttgtagtcccatcaaaccaagtgggttgtttgttagggaaaggaggggcaatagtctcagaaatgcggaaagccacaggggctaacataagagtaattgggaatgatcaggttccaatgtgtgtatcagataatgaccaattgatatcaggagtgttttcaaatgttcaagctgcaatacataatgcaactggtagactgcgagatcatctttttgtcagtacgcaaaacagtggtggagcaaggagcctttcctctgttctagctggaggccaaccaactcttgctatttctcatagtctcaatagacattctttgccaggattacaggcaccacagacagtggctgggataaattccagaggcaccaatggtgttagtcggggattgatttctcgaaaaggtggcttagaacttatcagtgggagtaaaactgccattgttactaatacaactgtgcaaattgtggttcctgatgatgttattggctctgtatatggggaaaatggtagcaatctggctcgcctgagacaaatatcaggggctaaggttattgtccacgaacctcgtcctggaacaagtgataggactattatcatatccggtacacccgatgaaactcgagcagcacagagccttctccaagcatttattcttgctggatcatcgtga

SEQ ID NO: 3293 - DNA, 1614 bp, Glycine Max
atggccgcactgaacctttgccgcatggcacttcgatcctcgaaacttctctatcgcccttataatcttctctccgttcagttgcagatgcagatgcaaccctcttctcctcccctcactcgaaagatgagcacggatgcgcagagtattgcttcccagcttaatagttctggattgttgaggactcagggccttattgcagggaaatggagtgatgcttatgatggtaaaaccataaaggtttataatccagcaactggtgaatctgttgtagatgttgcatgcatgggtggaagagagacaaacgatgcaatttctgcagcctatgatgcatatggatcttggagcaaaaccactgctgctgaacgaagcaaattactgaggaaatggtatgatttgctaatggtacataaagaagaacttgcacagcttataaccttggagcaggggaaacctcttaaagagtctgtgggtgagatagtctatggggctggctttattgagtttgcagctgaggaggcaaaacgtatatatggggatatagttcctgcacctttttctgatcggcgattatttgttctaaagcagcctgtaggggttgtaggtgcaattacaccttggaactttccccttgctatgattactcgaaaggttggtccagcccttgcatgtggctgtacagtggtcataaagccctctgaacttacacctctcactgctttagctgcagtggaactctccattcaagctggaataccaccgggtgtcgtgaacgtggtaatgggaaatgctcctgatattggggacgctttacttgcaagtccacaggtaaggaagatcacattcacaggctcgacagcagttgggaagaaattgatggctggttcagctgaaacagttaaaaaagtatctcttgaactcggtggcaatgcaccttgcatagtttttgatgatgctgacctggatgttgcagtaaaaggaactcttgcagcaaagttccgtaacagtggacaaacatgtgtttgtgcaaatagaattattgtgcaagaaggtatatatgagaagtttgcaaatgctttacgtgatgctgttcagaatatgaaagttggggatggttttagtgaaggtgtgtcacagggtcctctaataaatgaagctgctgtaaaaaaggttgagtccttaattcatgatgctacatcgaagggagcaaaagtaattcttgggggtaaaagacatagccttggacttactttttatgaacccacagtcatcagtgatgtcaacagtgatatgcacatatcaagagaggaagcatttggacctgttgcaccccttttgagattcaaaactgaagaggaagctatcagaattgctaatgacactaacgcaggtttgggttcatatgtatttacaaacagtatccaacgatcatggcgtgttgctgaggctcttgaatatggactagtgggtgttaatgaaggagtaatttcaactgaggtggctccatttggtggttttaaacagtctggccttggaagagaaggctccaaatatgggatggatgaatatttagagatcaagtatgtgtgcttcggaaacatgaacaaagaatga

SEQ ID NO: 3294 - DNA, 942 bp, Glycine Max
atggccgccaccgactcctccgctgcttcgtcacgccagctttcgcagagggagacggacatccagatgatgctcgccgccgacgttcacctcggcaccaaaaactgcgactttcagatggaacgctacgtcttcaagcgccgcaccgatggtatttacataattaaccttggaaagacatgggagaagcttcagcttgctgctaggattatagtcgccattgagaacccacaggatatcatcgttcagtccgccaggccttatggccagagggcagttctaaagtttgctcaatacactggagctcatgcaattgcaggaaggcacactcccggaacattcactaatcagatgcagcaatcctacaatgagcctcgtcttctgattctaactgatccaagaacagatcatcagcctatcaaggaaggtgctcttggaaatattccaactattgctttttgtgacactgattctccaatgcggtatgttgatgtcgggatccctgccaataataaggggaagcatagcattggttgtctcttttggctattagcaaggatggtactgcagatgcggggcactattcgtccagggcacaagtgggatgtaatggtggatttattcttctatagagaacctgaagaggccaagcaacaagaggaagatgaagcaccacctgcccaagattatgccatttcagacttcaatgctgctggcattggcagcttccctgctactgatggccaatggcctgctgcagtcgaacaaccctggactgaagaagctccacaaccaatctcagcagctcctactaactggacaccagaagcagctgctgcaggagattggggtgaggctgttccagctcctgctccagctccagttccacaagctggtgcgcctccagctcaagcttttcctcctgctactggctgggactag

SEQ ID NO: 3295 - DNA, 1986 bp, Glycine Max; identical to SEQ ID NO: 393

SEQ ID NO: 3296 - DNA, 1986 bp, Glycine Max; identical to SEQ ID NO: 393

SEQ ID NO: 3297 - DNA, 1986 bp, Glycine Max; identical to SEQ ID NO: 393

SEQ ID NO: 3298 - DNA, 1185 bp, Glycine Max
atggccgtggttgagtttgaacctcaacaactacgcctcttcatccccaacttcctctccctcgatgaatgcaaagaattggaattcatccataagagtagcagcacggtgggttacagacccaatgtcttctccaccactctctcccatctcattgctaccaactcttcccacttcatcattccttttatacccatcagagaaaggttgaaagacaagttagaggagtttttcaagtgtgagtatgagctcttcattgaattcactggtttaatcagttggagtagaggagcaagcattggatggcatagtgatgataacaggccctacctcaaacaacgccacttctcagcagtatgctatttgaatacttatggcaaggatttcagtggtggactctttcacttccaggatggtgagcccaagtcaattgtgccaaaagccggagatgttgtgatgtacacagctgatgaccgtaacattcattctgttgatgagataactgagggagaaaggctcacacttgctttatggttcagtcgtgatggctcccatgatgaggatatgaagctcatttctcttctttcacaacacctgctacatgagaacgtggctgattcatacctacctttgccagcatccagtaatatgtactggttttctaaggaccaagcttccaattatcaattcggttttaatatatcctgggctagactgcatgttcttggatacgacatatatatttctcaagacagtagctgtgagtctgatgtctttgaattactggtaaagccagtgcgtttagtgagggataatgagttgttagaccaggaattcgtcaatattatgcatgcacttcaggttgtccatttctattgttggaaaggatcagctttactgaacaacatgtcaaatatagactccaaggtactaaaagtgacagaggtacagagagagaaaatcagtggtctgaattctgtacttttgaatgataatgattttgcatccaaagttttctgtaatatgccttcggaagaaaagggatgcatttgctttgactggtcagaagttctagctgcagttgctgcttgggaagattatgcgtcaaacttaagcaaacaaattcatttacagttgccttactggagaatgcatgagtctatatataatgtgcaattagagtag

SEQ ID NO: 3299 - DNA, 807 bp, Glycine Max
atggccgttgctgaccccaagcctcactccgaacctaaggtctggaatttcttcaagcttccgttccgccattccgccaccaccaatacgacgccgtcttccgctaaccttcaccatcttcatcatcatcaccataaccatcaccacaaccctaataataatctccccctcgagggttccacttccaacacctccaattccgtttcctccgttgcgagatcgcttctcccgacacgacgtcgtctcaagctcgatccctccaacaagctttacttcccttatgagccgggcaaacaggttaggagtgccatcaggattaaaaacaccagtaaatctaatgtagctttcaagtttcaaacaacagcacccaaaagctgtttcatgcgtcctcctggggctatccttgcacctggtgagagtatcatagcaacagtgttcaagtttgtagagcaaccagaaaataatgaaaagcctgaaaaaactggactcaaatttaaaatcatgagcttgaaggtgaaaggattaattgattacgtccctgaactgtttgatgagcagaaggaccaagtagcagtggagcagattttgcgagttgtttttctagatccagagcgtccctgtcctgctttggaaaaactgaaccgacagctggctgatgctgatgctgcccttgaggcacgcaagaaacctgcagaagatgcaggtcctaaaattatcggggaaggacttgtcatagacgaatggaaagagaggagggaaagatacctcgcaaagcagcagggtgaagtggctgtagattctgtatag

SEQ ID NO: 3300 - DNA, 372 bp, Glycine Max
atggcctaccactcttctcaaaattcccaacctgctctccctatgcacctatgtttcttcttgctcaccttgttcatgttccttagtttctcattttactcaagctacgagccaataatggagagtttcatggaccaagtgaagttggttctaatggtttctccccttctgcttctgctagttgtgcacttcctttgcaactatggtagtggaggggttttgtcttcactgattcctcttccagagagagagtcactgcacagagcaggtggaactccttggggtgttggcttggttcttgttcttcttctcttcatggtgtcttaccagtcttctttccaggaacgttggtttcctctgctcacaaggtga

SEQ ID NO: 3301 - DNA, 360 bp, Glycine Max
atggcctcaaaatcatccaccattagacttgtttgtttctgctacttcatgctcttcagctctatgcatttcaccagctgcaccgtgctctcattgaaaagtcatgcaagcacatgcaatggttccatagctgaatgcaatcaagaagatgagctgttgatggagtctgaaataagccgaaggtttctggagcagaagagatcatacatttccaatggagctttacagagagacaaaccagtttgtaatggtggtggctctggtgaagcttatagtaaaactggagggtgtcttcctcccccctcaaatcctcaaagtagaggctgctctaagtattatcgttgtaggtctgactcttga

SEQ ID NO: 3302 - DNA, 585 bp, Glycine Max; identical to SEQ ID NO: 396

SEQ ID NO: 3303 - DNA, 1458 bp, Glycine Max
atggcctcagccgcatcccccaccactttctctctcctccactccgccaccccttcctcctcctccaccgccacctccgcctccccctccccctcgcgcgtgcagctcacctcctccctccgcgcccgcccgctgcgccgcctgggcttcgccgcggcggacccgctgctcgcggcgagtgtagcggcgcgcgtggcggcggtgagaggaggaggaaagggcgcgaggggggtggtgtcgatggcgaagaagagcgtgggggacctgagcgcggcggacctgaaggggaagaaggtcttcgtcagggccgacctcaacgtcccgctcgacgacaaccagaacatcaccgacgacaccagaatccgcgccgccattcccaccatcaaacatctcatccaaaacggcgccaaagtcattctctccagccacttggggcggccgaagggtgtcactcccaaatacagcttggcgcctcttgtaccccggctttctgagctcattggtatccagattgtcaaggccgaggacagtattggtccagaagtagaaaagttggtggcttctcttccagatggaggtgttctccttctagaaaatgtgaggttttacaaggaggaagaaaagaatgaccccgagcatgcaaaaaagcttgcctctctggcagatctgtatgtgaatgatgcatttggtactgctcacagggcacatgcatcaacagagggtgttactaaatacctgaagccatctgttgctggttttcttttgcaaaaggaacttgattaccttgttggggcagtatcaaaccccaaaaggccatttgctgccattgttggtggttccaaagtctcatctaaaattggagtgattgagtcacttttagaaaaagttgacatccttcttcttggtggaggaatgatcttcacattttacaaggcacaaggtctttcagtgggttcatcccttgtagaagaagataagttggatcttgctacatcactacttgcaaaagccaaggaaaagggggtgtctctcttgttaccaagtgatgtggtgattgcagacaaatttgctcctgatgctaatagcaaggtcgtgccagcatctgccatccctgatggctggatgggattggatattggtccagattctgttaaatcattcagtgaagcattggatactacccaaaccatcatatggaatggaccaatgggagtgtttgagtttgacaagtttgctgttggtacagaggctattgcaaagaagctggctgacctcagtggaaagggggtgaccacaattattggaggaggagattctgttgcagctgtggagaaagtaggagttgctagtgtcatgagccacatatctactggtggtggtgccagtttggagttattggaaggcaaagagcttccaggagtccttgctcttgatgaagccgtcccagtcgctgtgtaa

SEQ ID NO: 3304 - DNA, 375 bp, Glycine Max
atggcctcatgcaaatccttcatcacagctttctttcttcttgcaaccttctcatcaagcatgagtttgagcctagcatcatctcgtcacctcttgcaaacaaccacaacaccaaatttgcccggcatcactcccactttgcctaaccctacaggattgccacctttgccttcaaacccaacactgcctcagggcaatgttcctcctttgcccactatgccaactcttccatcacttccttccatttttccaacactcccttccctcaccctccctccatttccagcctcttcattccccaaaatgccctcaatcccaaacagtatcccgtccttccctttcttctccccaccaccttcaacatctagcccttaa

SEQ ID NO: 3305 - DNA, 780 bp, Glycine Max
atggcctccaccaaggaacgcgaaaactttgtctacaccgccaagctcgccgaacaagccgaacgctatgaagaaatggtggaagcaatgaagaatgtggcgaagctgaacgtggaattgacggtcgaggagcggaaccttctgtcggtagggtacaagaacgtggtgggtgctcgtagggcttcgtggaggattctatcgtcgattgaacagaaagaagaagctaaagggaacgatgtgagtgtgaagaggataaaggagtataggcagaaggtggagtctgagttgtccaatatctgcagtgatatcatgactgttattgatgaacaccttattccctctagctctgctggtgaacctagtgtctttttctacaaaatgaagggggactattaccggtacctcgcggagttcaagtccggtgatgagagaaaagaggctgctgatcattccatgaaggcgtatcagtcggcttccactactgcagaggctgagttaccacccacacatcccatccgtttgggcctggctttgaacttctctgtcttttattatgaaattttgaactctcctgaaagggcctgtcaccttgctaagcaggcatttgatgaagccatctctgagttggatactctgagcgaggagtcttacaaagacagcaccctaattatgcagcttctgagggacaatctcaccctgtggacttctgacatccctgaagaaggagctgaggaacaaaaggtggattctgccagagctgctggaggtgacaatgcatag

SEQ ID NO: 3306 - DNA, 780 bp, Glycine Max; identical to SEQ ID NO: 3305

SEQ ID NO: 3307 - DNA, 780 bp, Glycine Max; identical to SEQ ID NO: 3305

SEQ ID NO: 3308 - DNA, 780 bp, Glycine Max; identical to SEQ ID NO: 3305

SEQ ID NO: 3309 - DNA, 738 bp, Glycine Max
atggcctccaccaaggaacgcgaaaactttgtctacaccgccaagctcgccgaacaagccgaacgctatgaagaaatggtggaagcaatgaagaatgtggcgaagctgaacgtggaattgacggtcgaggagcggaaccttctgtcggtagggtacaagaacgtggtgggtgctcgtagggcttcgtggaggattctatcgtcgattgaacagaaagaagaagctaaagggaacgatgtgagtgtgaagaggataaaggagtataggcagaaggtggagtctgagttgtccaatatctgcagtgatatcatgactgttattgatgaacaccttattccctctagctctgctggtgaacctagtgtctttttctacaaaatgaagggggactattaccggtacctcgcggagttcaagtccggtgatgagagaaaagaggctgctgatcattccatgaaggcgtatcagtcggcttccactactgcagaggctgagttaccacccacacatcccatccgtttgggcctggctttgaacttctctgtcttttattatgaaattttgaactctcctgaaagggcctgtcaccttgctaagcaggcatttgatgaagccatctctgagttggatactctgagcgaggagtcttacaaagacagcaccctaattatgcagcttctgagggacaatctcaccctgtggacttctgacatccctgaagaaggaggtattcattaa

SEQ ID NO: 3310 - DNA, 738 bp, Glycine Max; identical to SEQ ID NO: 3309

SEQ ID NO: 3311 - DNA, 297 bp, Glycine Max
atggcctctcactacagttgcatcatcttggcttttgtcattgctatttccttttcaagcattgacatggcattagcatcacgcaatctccttcagacaacattgccaactttgcctcagggaaatgtccctcctttgcctgttttcccaaatcttccactgccacctttttccttccccaatattcctattcctaagatccccaacattcctaacattccctcaaaccccataattccaaccattcctaccatccctttcctctctccaccaccttcaaccaccaccaccccctga

SEQ ID NO: 3312 - DNA, 285 bp, Glycine Max
atggcctctctccgttttctcttctttgtttctttcttcattgttttgtcactttccatcaacattggtgaggtccaaggtgcaaatagaaaacttttggcaccaacatttcctgatataggcaacattcctggcgtgcaatatcctcctttccccccagtaaccgattggccagagtacaggttgccatcattcttaagacctaattaccccgcaattcctgcaaattattaccgctacactccccctgccaaaacaaccacaaccacagcttccaagccttga

SEQ ID NO: 3313 - DNA, 579 bp, Glycine Max
atggccttcattctcataattgcttctcttgttctatttctgtggatcgtttctctttgcaaagttctccttctcccccgcatccctttcgccaaacattttacgaataacaatggcagagcatttcggaagagaaatgtcttgttggttattgctcatcccgatgacgaatccatgttctttactccaactataaattttctgacttcaaaggggcataatgttcaaatactttgcttatctataggtgatgcagatggcaaaggaaatatcagaaaacaagagctttttcaggcttgtgtagccctcaaggttccgatgcaacaagtgaagattgtcaaccatcctgatctgcaggatggttttggtaaagtttggaaccatagcttattggcaaagattattgaggaagaaataaccagtcgttgcattgatatgattattacctttgacagctatggtgtctcaggtcattgtaatcatcgtgatgtgcattatggagtatgcaagctactgcatgatattttacaaagggatattgaagtttgggagcttcaccaatattttgcgcaaatatag

SEQ ID NO: 3314 - DNA, 783 bp, Glycine Max
atggccttcattctcataattgcttctcttgttctatttctgtggatcgtttctctttgcaaagttctccttctcccccgcatccctttcgccaaacattttacgaataacaatggcagagcatttcggaagagaaatgtcttgttggttattgctcatcccgatgacgaatccatgttctttactccaactataaattttctgacttcaaaggggcataatgttcaaatactttgcttatctataggtgatgcagatggcaaaggaaatatcagaaaacaagagctttttcaggcttgtgtagccctcaaggttccgatgcaacaagtgaagattgtcaaccatcctgatctgcaggatggttttggtaaagtttggaaccatagcttattggcaaagattattgaggaagaaataaccagtcgttgcattgatatgattattacctttgacagctatggtgtctcaggtcattgtaatcatcgtgatgtgcattatggagtatgcaagctactgcatgatattttacaaagggatattgaagtttgggagcttgttagcaccaatattttgcgcaaatatagtggtcctgttgatatctggttgtccatatttttgaccatgctgcacacaaatggaacaatgcagtgcttggtaaatgaacattcccgtaggagcggtattgcaatggcccaacattcaagccagtgggtgtggttccgcaagctttttgtaaccttgtccagttatacctatatgaacactcttagaaaggtaaagtaa

SEQ ID NO: 3315 - DNA, 654 bp, Glycine Max
atggccttcattctcataattgcttctcttgttctatttctgtggatcgtttctctttgcaaagttctccttctcccccgcatccctttcgccaaacattttacgaataacaatggcagagcatttcggaagagaaatgtcttgttggttattgctcatcccgatgacgaatccatgttctttactccaactataaattttctgacttcaaaggggcataatgttcaaatactttgcttatctataggtgatgcagatggcaaaggaaatatcagaaaacaagagctttttcaggcttgtgtagccctcaaggttccgatgcaacaagtgaagattgtcaaccatcctgatctgcaggatggttttggtaaagtttggaaccatagcttattggcaaagattattgaggaagaaataaccagtcgttgcattgatatgattattacctttgacagctatggtgtctcaggtcattgtaatcatcgtgatgtgcattatggagtatgcaagctactgcatgatattttacaaagggatattgaagtttgggagctttgcttggtaaatgaacattcccgtaggagcggtattgcaatggcccaacattcaagccagtgggtgtggtacgcatgctttaccttacttttattataa

SEQ ID NO: 3316 - DNA, 3021 bp, Glycine Max; identical to SEQ ID NO: 397

SEQ ID NO: 3317 - DNA, 447 bp, Glycine Max
atggcgaaaaaggcaaaagggtctcactctgcttcttctgcctctgcatcttcccgcaaactagtgctgaggattaaatcaaacgagggaatcaagagatcagtgcggcagactaattcaagaaagaaacccaaagcaaagcaaaagaagaacaaacaaatgtttgatgctatgaaacccaagaaacctccgacagctttcttctacttcttggaggattttcgtaaagaatttcaagagcagaatccagatgtaaagtcaatgcgtgatattggcaaggcatgtggagagaagtggaaaacaatgacttatgaggagaaggttcaatactatgatatagcaacaaaaaaacgtgaagaatttgataacgcaatggctgaatttaataagaaaatggaaaatggcgagtttgacgaaactgatgatgaatcagagtttgatgagtaa

SEQ ID NO: 3318 - DNA, 1326 bp, Glycine Max; identical to SEQ ID NO: 398

SEQ ID NO: 3319 - DNA, 1617 bp, Glycine Max; identical to SEQ ID NO: 399

SEQ ID NO: 3320 - DNA, 984 bp, Glycine Max; identical to SEQ ID NO: 400

SEQ ID NO: 3321 - DNA, 1002 bp, Glycine Max; identical to SEQ ID NO: 401

SEQ ID NO: 3322 - DNA, 1395 bp, Glycine Max; identical to SEQ ID NO: 402

SEQ ID NO: 3323 - DNA, 648 bp, Glycine Max; identical to SEQ ID NO: 403

SEQ ID NO: 3324 - DNA, 648 bp, Glycine Max; identical to SEQ ID NO: 403

SEQ ID NO: 3325 - DNA, 1119 bp, Glycine Max; identical to SEQ ID NO: 405

SEQ ID NO: 3326 - DNA, 1344 bp, Glycine Max; identical to SEQ ID NO: 406

SEQ ID NO: 3327 - DNA, 1734 bp, Glycine Max; identical to SEQ ID NO: 407

SEQ ID NO: 3328 - DNA, 1545 bp, Glycine Max; identical to SEQ ID NO: 408

SEQ ID NO: 3329 - DNA, 342 bp, Glycine Max
atggcgaagtcattgagatcgaagagggagaagaggctgagggctattcggagggagattgttgaacctttctatgacaagaaagaagctgctaagcttgctgcccaagaggctgcccttgccgcccctaagctggaggttccttcgaaaccaaatactgctatggaagcatccgcttccactgacaacaccaacatggatgtggaggtggctgatggaagccaaagcatggcttccttaaagcctgttggtggaatagggaagaaatccaaaaagaagttgaaaatagctaaaaacaaacgccgtggtaatggaaagcacaggagaacccgtaagatatga

SEQ ID NO: 3330 - DNA, 342 bp, Glycine Max; identical to SEQ ID NO: 3329

SEQ ID NO: 3331 - DNA, 1326 bp, Glycine Max; identical to SEQ ID NO: 409

SEQ ID NO: 3332 - DNA, 1068 bp, Glycine Max
atggcgacccatctccccgactacttcaagtgtccaatctccctggaaataatgtcggaccctgtcatcctctcttcgggtcacaccttcgaccgttcctcaattcaacgttggctcgatgcgggtcaccgaacatgtccaattaccaaactaccccttcccgaccacccctccctcatccccaaccacgcgctgcgaagcttaatctccaactacacattcctctcccctctccaccaaacaatttcccaacccgaaaccctaatttcaaccctcacttccaattcttcatcctccgattccaaaattgaggcccttaagcacctcacgcgcttatcgatgcgcgattcggcgttccgccggaggctggcggagtccggtgccgtccccgccgttctcgccgccgtggacgacccgagcctccaggagaaggcgctccccctgctcctcaacctcaccctcgacgacgactcgaaagtcggcctcgtcgccgagggcgtggtcgcgcgagtggtagcggtgctcctccacgcgccgtccccggactgccgcgccgtcgcggcgaccatcgtcacgagcctcgcggtcgtggaggtgaacaaggccaccatcggcgcgttcccggcggcgatcgcggcgctcgtggcgatcctccgcgacgggggcaaggggcgggagcggaaggaggctgccaccgcgctctacgcgctctgctcctttccggacaaccggagaagagccgtgagctgcggtgcggtgccgattctcctcacaaacgtcggaattggactcgaacggtgtgttgaggtgatcggcgttttggcgaagtgcaaagaagggagggagcaaatggaatgttatgacggttgtgttcagattctggttaacgttttgaggaacggaagctcgagggggattcaatatgcgctctttgcactcacttcggtttgttcttatagccaaagaatggttatggtggctctggaagaagggggtctagaagcttctcttgggtttgtggaagatgataatgagaaagtgaggaggaatgcatgtaatttcattaag

SEQ ID NO: 3333 - DNA, 1221 bp, Glycine Max
atggcgacccttttccagggattgggagttgtgaacccatcattggcttcttcaaactccaacaagttccatcttccttctcgtacatccctctcagagaggaaagatggcatttttgtggtcagatctgatgcaacaagggtaagcagccaggttctgaaggctggagctcgtaagcatgaattgttagttactaatgcagttgcaacaaaggaaggccgtcctgcggcttctacatcaaaatctgggcatgaacttctcctttttgaggccctacgtgaaggtttggaagaagaaatggagagggatccttgtgtatgtgtcatgggcgaagatgtaggtcactatggaggatcctacaaggtgactaaaggtcttgccacaaagtttggggaccttagagttttggacacccctattgctgagaactccttcacgggcatgggcattggggctgccatgactggtctgaggccagttgttgagggcatgaacatgggattcctacttctggcatttaaccagatctctaacaattgtggcatgctccattacacatctggaggccagttcaagataccaatcgtcattcgtggacctggtggagttgggcggcaacttggagcagaacactcgcagcgattggagtcgtattttcagtcaatccctggaatccagatggtggcttgctcaaccccttacaatgccaagggcttgatgaaagctgcaatccggagtgagaaccctgtgattcttttcgagcatgttttgctttataacctcaaggagagaattccagatgaagagtatgtattgtcactcgaagaagctgaaatggttaggcctggggagcatgtcacgatattaacctattccaggatgaggtatcatgtcatgcaagctgctaagacactggtgaacaaagggtatgaccctgaagtaattgatatcaggtctttgaaaccattcgatcttcacacaattgggaattcggtgaagaagacacatcgtgtgctaattgtggaagagtgtatgcgaacaggtggaattggtgctagtttgacagctgctattactgaaaatttccatgactatttggatgcccctatagtatgtttatcctctcaggatgtgccaactccttatgctggaacattggaggaatggacagtggttcaacctgctcaaattgtgactgcagtcgagcagctctgcaagtga

SEQ ID NO: 3334 - DNA, 624 bp, Glycine Max; identical to SEQ ID NO: 410

SEQ ID NO: 3335 - DNA, 948 bp, Glycine Max; identical to SEQ ID NO: 411

SEQ ID NO: 3336 - DNA, 948 bp, Glycine Max; identical to SEQ ID NO: 411

SEQ ID NO: 3337 - DNA, 1206 bp, Glycine Max
atggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgtaacacctaaatacagtttgaagcctcttgtgccaaggctgtctcaacttctcggaattgaggttacgatggcaaatgactctattggggaggaagttgagaagttggttgcacaacttccagaaggtggtgttttgcttctagagaatgtgaggttctataaggaggaagagaagaatgaccctgagtttgcaaagaagttggcttctcttgctgatctctacgtgaatgatgctttcggcactgcccacagagctcatgcttctacagaaggagtggccaaatacttgaagccctctgttgcaggattccttatgcagaaggaacttgactatctagttggagctgtgtcaaaccccaagagaccatttgctgctatcgttggtgggtcaaaggtgtcttccaagattggagttattgagtccttgttggagaaagttaacgttctcttgcttggtggaggaatgatctttaccttttacaaggctcagggttattcagttggttcatctcttgtggaggaagacaagcttagccttgcaactacacttctcgaaaaggccaaggctaaaggggtttctttgttgcttccaactgatgtggtcatagcagacaagtttgctgctgatgctaacagcaagactgtgccagcatcaagcatcccagacgggtggatgggattagatattggtcccgattccatcaagacatttggtgaagcattggataagacccagaccgtcatttggaatggaccaatgggtgtttttgagtttgataagtttgccacaggaacagaggccatagccaagaaactggcagagctgagtgggaagggagtaacgaccatcattggaggaggtgactctgttgccgctgtggagaaggttggtcttgcagacaagatgagccacatctccactggtggtggtgccagcttagagcttcttgaggggaagcaactccctggtgtccttgcccttgatgatgcttga

SEQ ID NO: 3338 - DNA, 549 bp, Glycine Max
atggcgagaaactgggtggttcgatccttggcgcttcgtcacgcaatgaagaatagggttctcacactctccttcaaccgaattcttccctcactcccatcaaaatcctctctcttagccaccaccgccgccgccactgcctcctctcagctctccctcctcccctccttccaccactctcgctccctctcctccgcctcagctccttccgacgttgtccttgttaattccgaggaagagttcaacaatatccttaccaaagtccgagatgactcgttgcacgcggtcttctatttcactgcggcgtggtgtggaccttgcaggtttatttcacctatcgttggggagctcagtaagaagtaccctcatgtaacaacatataagattgacattgatcaggaagcacttcaaggcacactgggcaagttgcagatttcatctgtgccaacacttcatttctttcagaatgggaaaaaggctgatgagcttataggtgctgatgttgcgcgattaaactatatcacagagaaactcttcaagaaggactga

SEQ ID NO: 3339 - DNA, 306 bp, Glycine Max
atggcgagagtgcctctcatttgcgttccaaacagccctagcttacaccataatgggttgtgtcaccctcgtagccttccttgcattctcattatcataaacgacgccgctttgggagacgccttccatgtctatgccacccttcagagcataggccccaccatcttgagcttgtgggttgtcggactagggccgctctctaaagtcaccaccgctgtagcggtggcgctcgccgcgtttgtggtggttctttcctggcctcagagcacaaatttgatagctaaacgcatatcattgggtcagata

SEQ ID NO: 3340 - DNA, 1048 bp, Glycine Max
atggcgagtccaagcaagtccaacacacgctatgtgggaatatggtacaacaatttgcctgaaaaaccgtggtttgggttgcaaacagaaacagtcccatcaataacacttctggggttctctcaatcgacccaaagggaaaccaactatagcaccattcccatttggtctaccaatgtttcagccaccaaatcaaacaccaccaccatcaacgtcatagctcaactctcagacgtagcaaaccttgttttgattctaaacaacaccaaaaccaaaactctcatctggcaaagctttgatcatcccacagacaccttgattccatatttaagaattggttttgacagaagagctaatcagagttggttcctccaatcatggaagacagatgatgaccctgaactctcccttgtggagtggttggatcgtggaatgcaactctcatacaacatgtttgataattccataatccctaggatagtagttcagcaatctggtttctttcaagtattcacttgggataaccaaaagagtgaatggaaaaggtactggtctgaaccaacaaatcagtgtgataactatggaacctgtggatcaaacggtaactgtgactctttgaactttgaggactttaggtgcacttgtctacctggttttgagcctaaatttccacatgattggtatgagaacagagatggatcaggagggtgtgtgaggaagccaggagtatccctttgtgggaatggagaaggctttgccaaagttgaaggcttgaagattcctgatacctctgtggcaattcccacaaggggtttgagtttggaagagtgtgagaaggaatgcttgagaaattgttcttgccctgcatattcagttcttgaggtgaggaatggtgggagtgggtgcttggcatggcatgggaatttgatagacatacaaaaacttagtgatcaaggccaagatttatttgtccgtgttgatgttgttgaactagcaagtgtcattcttttctctggtgtgtattacctttggaagagaaaaagcaaag

SEQ ID NO: 3341 - DNA, 3276 bp, Glycine Max
atggcgattgtgaccggagatcggtacctggagaagctggtgcagttcgtggagaaccaggcgggtcctctgatcgaaggagccttggtgttgaagctaaatccggcgggtctccactacgtgcaatccagactggaggcgctgcacgagctcgaaagccttctcgccggcgctccggtggactacctccgagcctacgtgtcggacctcggcgaccaccgcgccctggagcagctccggcggatcctgcgcctcctcacatcgctgaaagtcgtttcggtgctgcctcatcccatcagggatcccacgcccttgtcgttcttgccgtttgtgcgcttgaaggttctggaactcaggggatgcgacttgtcaacttccgccgccaaaggcttgctcgagctcaggcacacactcgagaagatcatttgtcacaactctaccgatgctctgcggcatgtgtttgctagcaggattacggaggtgaagaattctccgcagtggaaccgcttgtcctttgtgtcatgtgcgtgtaatggcttggttctcatggacgagtctctacagcttcttcctgcggttgaaacgcttgaccttagcaggaacaagtttgcaaaggtggataatctacataagtgtaccaaattgaagcatttggaccttggtttcaatcacttgagaacatttgcacccttcacccaggtttcctgtcttattgttaaactagttttgaggaacaatgctctaactactttgcgtgggattgagaatttgaagtcacttgaaggacttgatgtttcctacaatattatttccaatttttcagagctagaatttgttgcggggcttccatatcttcaaagcttgtggttggaaggaaatcctttgtgttgtgctcgatggtatagagcacaagtattcagcttcttctcctacccagaaaggttgaagttagatgagaaagaaattaacactagtgatttttggaagagacaaataattattgccagtatgcataagcaacctgccagttttgggatttatgtgcctgcaaaggatgaagctgtcattgaaggtggcaatatcagaaggcagaaaaaggtctctcgtcttgtcagtataaaaaatgaagagaccactagcatatgttctgacgaggactctgcctcttgtgcaaatgatattcaaaatagacaggatcctgatttatctgacaatgaagctgaaattgtagatttgataaatagagttgaacatatgaagaaagagcgttctattcattggttgagggaatttaaagactggatggatactgcttctgacaaatcagtagaaactagaaaggaaggcggtgcttccctgcatcatcagaaggaaaattacatcaggaagaagacaaatcaggagcagtctggtgacatctcaagatatgcttcagactcagttctagcctcgggagatgacagtagcatgaatattttagaatctgatagttcttttgtagatatgtcagctagttatcatagacagcagcactttgactatagaggtttgcttggtaatgttagtggggcttcacattttgactcaagaggagtggacatggagcgccttaaatcctcacttgagggaattagtagttctctctcacaacctagaagttctcattctgacactgttaccacccaaggagcacaaagaatgactgaaaatgtcaacatctcaccattgataaccattcatgatatatctgggtctcagtcatcatctgcttgccccacttctcctccacattttcaagaagaccttcttcatcgccggcaacacttggtggaggaaattttgcagctttcagcagattccttttcagtggcatcttctgatagtaacacaagctgtagtgaagttgattgcagtgaatttgagtcatcagtgcctaaagttgataatttcccgtgcaaatattatatgaatggaagtgttgatggtcatttatctcaaaatctgctcaaggaaaagttttacaacccaagacaaggaattcttcatgcaagagaaaatggaaattctttatctagtcctacctgtgacccaacttctaagcagcattcaattgactttgctgctggtgctgacaatgctgagagtgcattttgtgctagccaagacactggtttgttggagaaaagaaaaattagaaaaaaagccaagaagagaattatttcaatattagaagagaatttagatggtgatgcatctgatcatacacaagaacagataagtcaaggacagatttctccaaatttaaaacaagaattggacattgatgattctactgaattttctgggcgcaattactctacccaagagaatgatgatttgattgtgacatatttcaatacaagtattgctgattctgaagctagtgaggtctgtagtcattgtatgcgctgtaattgtgtccttcagagggagacaaactataaagaaagcgaagttgcagtgttgctgagcagccataagaagctctatttgctactaatcaacgttgattctaatgggtcaggaacacttttgagtgtattgagttgccacaaaattgaagaagtttgtgaggtgctagtaggaatgggacttcaggtgttaagggtaaattttgagaatggggaaacgtatctttttgtaacaagaagcattgagaaatcaagagaattactatgtaccatacacgtgcttgattcatgtggtggaaatggtagatgctcaataagaagtttggagcagatccaggttgagttgtttgacaatcaaatatgtggtggttcaaatgtgagcatatatcagtatgcaatggtgctcgtcttttctaaatatggcagtgaggaatcatggctatcgagatcactctttgtgattggagggaatgtgcttatatgcattgaagatcttaagcagctgtactcattatcatcaaatgcgtctgcctctccatacttcagaattgattcatgttgctccattgctgacattgctgagatggttattgaggttggtggcagctgctgtgtgactttaggtctgacttgtccacgggcagaactccatccatctacccaaatgaaccttcaaaccgtcaatcatgaaaatactgctcccgggtctcttaaattgaagcttcagtggttctctaaagatcaccttgtgaagtttgtgtcattgttgaagacaatccatgaaaaagaaacggggtcacctttggtagtaagatgtatatcgtaa

SEQ ID NO: 3342 - DNA, 651 bp, Glycine Max; identical to SEQ ID NO: 413

SEQ ID NO: 3343 - DNA, 984 bp, Glycine Max; identical to SEQ ID NO: 414

SEQ ID NO: 3344 - DNA, 699 bp, Glycine Max; identical to SEQ ID NO: 415

SEQ ID NO: 3345 - DNA, 579 bp, Glycine Max; identical to SEQ ID NO: 416

SEQ ID NO: 3346 - DNA, 570 bp, Glycine Max; identical to SEQ ID NO: 417

SEQ ID NO: 3347 - DNA, 699 bp, Glycine Max; identical to SEQ ID NO: 418

SEQ ID NO: 3348 - DNA, 690 bp, Glycine Max; identical to SEQ ID NO: 419

SEQ ID NO: 3349 - DNA, 696 bp, Glycine Max; identical to SEQ ID NO: 420

SEQ ID NO: 3350 - DNA, 570 bp, Glycine Max; identical to SEQ ID NO: 421

SEQ ID NO: 3351 - DNA, 696 bp, Glycine Max; identical to SEQ ID NO: 422

SEQ ID NO: 3352 - DNA, 2985 bp, Glycine Max
atggcgccgagcaccggagacgtgcaactaacttcccccggcgccggccaagatttcgacgacctcgaagacattcgcctcctcgactcctacgacaaaaacgacgtcgtccacgatgaaaccaaacggattcaggtcagaatctccggcatgacctgcgccgcctgctccaactccgtccaaacggctctccggtccgttcacggcgtcaccgaagcctccgtcgctcttcttcagaacaaagccgaagtcgttttcatccccggcctcgtcaaggatgaggatattaagaatgcgattgaagacgcaggtttcgaggccgagatcttgccggactccggcgcggcggcgcacgctgccgcctccgccgccgtgttggggcagtttactatcgtcgggatgacgtgtgcggcgtgtgtgaattccgtggaaggcattctgagaaacctcaacggagtaaaaagagcggtggtggctctggccacttcgttgggcgaagttgagtacgatccccacgtgattagcaaggacgatattgtgtctgcgattgaagacgcgggtttcgagggcgcgtttgtgcagagtaacgggcgggaccagatagtgttaggggtgagtggcgtgtactctcttggtgatgctcaggttctggaagcgatgctaagtggcaccaaaggggtgaggcagtttcggttcgatacggcagtgaacgagcttgatgtggtgtttgaccctgaagttatcagctctaggtcgttggttgatgggatccagttggggagtaatggcaagtttaagttgcatgttaggaatccttacgctaggatggcttctaaagatggctcagaaagctcggctatgtttcgcctttttatttccagcttgtttctcagtattcctctcttcttcatgggggtgatttgtcctcatataccattggtttactctttattactttggagatgtgggccttttctcatgggtgactggctgaattgggcgttggtgagtgtcattcaatttgtgattgggaaacgcttctatatagcagctggaagagctcttagaaatggttcaacaaacatggatgtcctggttgctttgggaactacagcctcttatgtttattctgtttgtgctcttctgtatggtgcccttacaggattttggtctccaacatactttgaaacaagtgctatgcttataacatttgtattgttgggcaagtatttggagtgccttgccaagggaaagacctctgatgccattaagaagctagtagaacttactcctgcaacagctttattgattgtcaaagataaaggtggtagaactattgaagaaagggaaatagattccttgctcgttcaacctggtgacacattaaaagttcttcctggtacaaagattcctgctgatggtattgttacttggggctcaagttatgtaaatgagagtatggtgactggtgaatctatacccgtttcgaaggacgtcaatgcatctgttatcggaggtacgatcaatttgcatggtgtccttcacgttcaagctaccaaagtaggatctgatacagttttgagtcagataattagtttggtggagacagcccagatgtccaaagctcccattcaaaagtttgctgattatgttgcaagcatatttgttcctacagttgtggtgttggcattattgacactattgtgttggtatatagctggggctcttggagcataccctgatgaatggctgccaaaaaatggaaatcactttgtttttgcccttatgttttcaatatctgttgtggtgattgcatgtccatgtgcacttggtttggcaacaccaactgctgtcatggtggcaacaggggttggtgccaacaatggagtattaattaaaggaggagactccttggaaagggctcagatggtgaagtacgtcatatttgataaaacaggcactctaactcaggcgaaagccactgttactgctgctaaggtgtttgcaggaatggaccgtggagattttcttacattggtggcttctgctgaggctagcagtgaacacccactggcaaaagcaatatcgcaatatgcgcgccattttcatttctttgaggagtcttcccctaccagtggtaccaagaatgctgctgaggagttcaagtcagggtggctttatgatgtctcagacttctctgctcttccaggaaggggcatccagtgctttatagacgggaggcgtattttggttggtaaccggaagctgctggaggaaaatggcataaatatttctacagaagtggaaagttttgttgtagagattgaagaaagtgcaaagacagggatactagtagcatatgatgatatattaattggagtcttagggattgcagacccactaaagagagaagctgctgttgttatagaaggcctacagaaaatgggagtcatacctgttatggttacaggagataactggagaacagctcgagctgtagccaaagaggttggcattcaagatgttagggcagaagttatgcctgcaggaaaggctgatgttgttcgttcattccaaaaggatggaagtatagttgcaatggtgggtgatggcatcaatgactctccagcattagctgctgcagatgttggtatggcaattggggctggaacagatgttgcaatagaagctgctaactatgtgctgatgagagataacttggaagatgtgatcacagccattgatctttccagaaagacctttttccgtattcgattgaattatgtatttgcgatggcttacaatgttgttgctataccagttgctgccggggttttctttccttctttggggatcaagctgccaccatgggttgctggtgcatgcatggctctgtcatctgtaagtgtcgtatgctcttctttgcttttgagaagatatagaaaacccaaacttactacaatacttgaaatagttgtaaattaa

SEQ ID NO: 3353 - DNA, 1008 bp, Glycine Max
atggcgccgcctcccaagccagtgccatggaacgccgacctaaacaaaattaatgaaatatttgagagtgagaaaagtggtgctgtggctttggagaaggatggtgaggttgttgatttggtggtgagggaggaggtggagagggtgaagggttacccgaaactggtggcgccggcgacggtgggggcggacggggagtttatggtgggggccgcggtggggacgagggaagatgataaggagaggttggagcatttggtgaaggctgggttgaatgttgtagtgttggatagttctcaggggaactcaatttatcagttagagatggtgaagtatgtgaagagggtttaccctgagcttgatgtgattggggggaatgttgtgactatgtaccaggctgagaatctgattcaggctggggttgatgggttgagggttggaatggggtctgggtccatttgtactactcaggaggtttgtgctgtggggcgtggtcaggcaactgctgtttacaaggtctcgtccattgcttataaaagtggtgttcctgtgattgctgatggtggcatctcaaactctggtcatattgttaaggctttgtcattgggagcgtcaactgttatgatgggaagcttcttagctggtagtcttgaggctcctggggcttatgtgtatcagaatggtcaacgtgtgaaaaagtacagaggaatgggttccctagaagccatgactaaagggagcgatgcaaggtacttgggtgatacagcaaagctaaaaattgctcagggggttgttggagctgttaaagataagggctctgtcttgaatttcataccatacaccttgcaagcagtcaggcaagggtttcaggatatcggtgccaactctctacagtctgctcatgaccttctaagatccagggtgttaagactggaggtccggagtggagcagcacaagttgaaggtggaattcatgggctggtttcttatgaaaagaaatacttttga

SEQ ID NO: 3354 - DNA, 969 bp, Glycine Max
atggcgctgccttggccggtatttaacagcattgacattcaccgaatcatgttgaacactaaaaaaggccattcatctttaattgttgtgacatttaaacatgattttcttgtgatagtttcctttccttgcttctggcttgatttattggaggattttgataaagaatttcaagagcagaatttaggtgtaaagtcaaggtgtgattgggataaagttttgttgttcttgttggaaggacaagatagtgtggggttttatagagccttggactccctcaactacaaaatctaccttttgtggtgtgtttctcctaaagagaaggttaaatactatgatatagcctcagaaaaacgtatagaatttgatagagcaatggcaaaatttaacaataaaatggtaagcaatcactcattttccttgctattgagttgtctcttatttgcccggttatggaatattcaatttattttctgctgcttggcaggaaagtgggggagtttgacgaaattggcaatttctttgtttacatcaatggggatacagggattgggatctcttaagctacactttccagatgtacctgtcatggcattgactgccactgcaacgcatgcagttcgtgaggacatcttgaaggctttaagaattccccatgcacttgttcttgaaagaagctttgaccgaccaaatttgaaatatgaagtgattgctaagacaaaggagccaataaagcagcttggacagttactaattgatcgcttcaggaatcaatgtggaattgtttactgcctttcaaaaagtgaatgtgttgagctctccaaattattgagtgagaaatgcaagatcaaaacagtgtattatcattctggcttgtctgcccaccagagagtagccgttaaaaaaaaaatggtaatgatggagaggtccatattgtatgtgcaactattgcttttggaatgtggatag

SEQ ID NO: 3355 - DNA, 1092 bp, Glycine Max
atggcggagaaggatgtgccgaagcttaagctgaaacctcgaagactcaagggtcacgacgacagcacaacctgctgcattgcctcacgtgaacgctctcatctgattgtcacttccggcgatgatggtcgtgtttgctggtttgacctgcgatgtcctgatgtgccgcaactggttatggatgttagtgtggagccagtttcgtccttttgtttcaagtcaggaatggaagatatgatttatgtctcctcagggaaggaaatcaagtgttttgatgtgcgattggccgccgcccaatggaagccattggagaattataattataacaaagaggagataaacaaggttgtatgcaactcaaagtcctcatttgttgctgcagcagacgataatggtgaagttaagataattgacattcgccagcaatgcctgtataaaacactacgagctggtcatacaagtatatgtagcactgtggaattccttccttggagatcttgggaggtcattagtggaggtcttgattcaatgctcatgttgtgggacttctccaaagggcgcccctacaaagtagtggattttgctacatttgatgtgagtagtggcattgctggccggtgtgtcaatcctgcttttgttcatgcaatagctgttccagaagttgacatgctagataaattagacaaaatatgcgctgctgcaaggggcgatggagctattgatgtgattaatattgaaacagaaatggctgctacaaaatcaaaaagctcttcaaattcacgaaaaggatcacactcaagatcaaaagatggtagttcatctagcaatacagacgcagatcaaaatggaaaaaagaggttgcatttgaattacactttgggtggccatactgcagctgtttccagcctggcattttcattgtttggggaaagagggaaattcttgatatctggaggaaatgataagttggtgaagatatggaattggtcctgttatccagatgtagggttaagtgacgacaataacaataatatcctacatttgaacattgaagtatctcgaaaagtgagttttgtaatatatttaatttaa

SEQ ID NO: 3356 - DNA, 1191 bp, Glycine Max
atggcggagagtggcggaggaaatcgccggagagaaccgcttctggtgtcgccggaggaagaggctgcaaaagcatcgtggaggcttaacgtcaaagagtttcgtttgccaagccaaacgaatgatcatcaaaatcaacgatccttcactttccatggccttcttcgtaaacccaggaagcaacgcaaagtggcagaatattacaagaatcaggagagactccttgaaggatttaatgagatggagactatgactgaagagggtggtttcccaggatctctaactgaggatgaaatgaagcaactagccaagagtgagaggatggctgttcatgtgtcaaatatgtgtaacttggtgctgtttgcagcaaaggtttatgcctcagttgcaagcagatcattagcagtcattgcctcaaccatggattctctcttggatctcttgtcaggattcatattgtggtttacttctaatgccatgaaaaacccaaatcaatatcactatccaattggaaagaaacgcatgcaaccagtgggtatcattgtttttgcatcagtgatggcaaccttggggttgcagattttgattgaatctgcccgagaacttatttccaagtctaagcctgatatggatccaacaaaactgcattggatgatcggaattatggtgtttgtgactgtagtgaagttcattcttatggtctactgtcgaagattcaaaaatgaaattgttagagcatatgcacaagatcacttttttgatgtcattactaattctgttggattagctgctgctgtgctagctgtcaagttctgctggtggattgatccaacaggagctattattatagcattgtatacaattaatacatgggccaagacagtcattgagaatgtttggtcacttattggaaggacagcaccacctgattttctagccaagttaacgttcctcatatggaatcaccatgaacagatcaagcacatagatactgttagagcttacacctttggtgcacattactttgtggaagttgacattgtgttgccggaagacatgcttctccaccaagcacacaacattggtgagacactccaagagaagctggagcagcttccagaagtcgaaagggcttttgtgcacgtagattttgagtccactcacaggccagagcacaagaccatggtgtga

SEQ ID NO: 3357 - DNA, 3144 bp, Glycine Max; identical to SEQ ID NO: 423

SEQ ID NO: 3358 - DNA, 474 bp, Glycine Max
atggcggaggcggcggttcaggcgtcgacggcgttgaggacgtggagagggctgtcgatgaaggaagatggagagttgagattcctaaactttgttttctattacaacagtttcctacttgagttagcttcagttattggcaaattcatcaaagtatgtgtggaaattaatctccataaactgatggtcagtcaagtactcaagttaagattaggagtcagtcattggtacaacattgaatatgaaggccaatacttactttgcaggaaatatggacattatggccatcataccaattaccaaagattgtttgtttcctcccataaatcctcaattgcccagaattatgttattaattattcaaataaaaacgataacaaaacagggggcggatatgcatggagaatgataatttggattgagggtaccatgattttgatttcaacacctaccttgtttcacacacacaaataa

SEQ ID NO: 3359 - DNA, 624 bp, Glycine Max
atggcggatccgaaagcctactggtgccacgagtgcgacatgagcgtgtccctgacgctcccaccctcccctctcctctgcccgcactgccacacccacttcctcgagctcatggactccccaaccctctcccaaaacgacaccgaatcctccctcttcgacgtcgttttccaagacgctctcttactcctcaaccccccttcctcaaaaccccgccccctcccctccctccacgtcaccccctccctcctctcctccctcgaccccaacggcgtcgttcgctgcgccgtctgcaaagaccaaattaccccccacgccgaagccaaacaattaccctgcaaacacttataccactccgattgcatcacgccgtggctcgaactccacgcctcgtgtccgctatgcaggtttcggttggaagaagaggaggaagaaggcggtgacggcgttatgacgaagatcaggagggagattattgccaggctgacggtgctgacggaagaggatttctacgggctgaggaccacgctcaaccacattgcctcgcgccacgcgctcatccaagagaacgagaatcgcggcgcccagattggggaaactcaaggtggcgattcggcttgctga

SEQ ID NO: 3360 - DNA, 387 bp, Glycine Max
atggcggatcctgagttggaagcaatcagacagagaaggttgcaggagcttatggctagccatggtggcggaaatcaacagaaccctgaacaggagaaagctcaggatgatgcaaagagggaggctgaggaacggagacagatgatgcttagtcagatattgtctgctgaagcgcgagaaaggcttgctcgaattgctttggtgaaacctgagaaagcaaggggcgttgaagattttatattgagagctgctcagatgggtcagataactgaaaaggtttctgaggaaagactcatatcactgttggagcagataaacaaccaaacaacaaggcagacaaaagttacaatacagaggcgtcgaagtgttcttgaggatgatgattaa

SEQ ID NO: 3361 - DNA, 384 bp, Glycine Max
atggcggatcctgagttggaagcaatcagacagagaaggttgcaggagcttatggctagccatggtggcgtgggaaatcaacagaaccctgaacaggagaaagctcaggatgatgcaaagagggaggctgaggaacggagacagatgatgcttagtcagatattgtctgctgaagcgcgagaaaggcttgctcgaattgctttggtgaaacctgagaaagcaaggggcgttgaagattttatattgagagctgctcagatgggtcagataactgaaaaggtttctgaggaaagactcatatcactgttggagcagataaacaaccaaacaacaaggcagacaaaagttacaaggcgtcgaagtgttcttgaggatgatgattaa

SEQ ID NO: 3362 - DNA, 390 bp, Glycine Max
atggcggatcctgagttggaagcaatcagacagagaaggttgcaggagcttatggctagccatggtggcgtgggaaatcaacagaaccctgaacaggagaaagctcaggatgatgcaaagagggaggctgaggaacggagacagatgatgcttagtcagatattgtctgctgaagcgcgagaaaggcttgctcgaattgctttggtgaaacctgagaaagcaaggggcgttgaagattttatattgagagctgctcagatgggtcagataactgaaaaggtttctgaggaaagactcatatcactgttggagcagataaacaaccaaacaacaaggcagacaaaagttacaatacagaggcgtcgaagtgttcttgaggatgatgattaa

SEQ ID NO: 3363 - DNA, 504 bp, Glycine Max
atggcggatggaagcagcggggaaattctaatgctggaagccccagcgtcttacggtaggtctagcgattccgacgcggaaataatcgacgcattgccttatatcgacgacgactacgcagaccccagagtcaaactggaggttgaccgtctcgtggaggatgagatgcgtcgcagcaccaagaagcccaccgatttcctcaatgatttccctcctcttcccaactccattttccagaactacccaatgattgccagagagtacgaacgtgtgagagctggaaggcctcccgttgctcttgatagatcgcgctacgatttggaaatgccgccgcccaataaaaggaacgacgaaactgcttggaagcaagctcttcatagagctcaacgcctgctgcaatatcagatcatcaggatggaaaatttggacttgatgttaaaatatggtcccgatacctggaaacagcacaaccagagattggaagtatacttgtcaagaaattag

SEQ ID NO: 3364 - DNA, 759 bp, Glycine Max
atggcggatggaagcagcggggaaattctaatgctggaagccccagcgtcttacggtaggtctagcgattccgacgcggaaataatcgacgcattgccttatatcgacgacgactacgcagaccccagagtcaaactggaggttgaccgtctcgtggaggatgagatgcgtcgcagcaccaagaagcccaccgatttcctcaatgatttccctcctcttcccaactccattttccagaactacccaatgattgccagagagtacgaacgtgtgagagctggaaggcctcccgttgctcttgatagatcgcgctacgatttggaaatgccgccgcccaataaaaggaacgacgaaactgcttggaagcaagctcttcatagagctcaacgcctgctgcaatatcagatcatcaggatggaaaatttggacttgatgttaaaatatggtcccgatacctggaaacagcacaaccagagattggaagtatacttgtcaagaatgcagaaattagctcaggaacaaaatgaaaagattgaaaaagtaaaccgtgaaaggaaatatcatcagcaaaacactgcatatgagcttaatgcgttgtccatgcaatggaaggagctttgtcagaagaatatagacatcagtgctgcctgtgcttcagttgaaaatcgcataaatgaactgaaaagagaagcagcagaaagaggctggaacttgggagctgtaacagaaaatgaccaattggcaaattccgaattatga

SEQ ID NO: 3365 - DNA, 732 bp, Glycine Max
atggcggatggaagcagcggggaaattctaatgctggaagccccagcgtcttacggtaggtctagcgattccgacgcggaaataatcgacgcattgccttatatcgacgacgactacgcagaccccagagtcaaactggaggttgaccgtctcgtggaggatgagatgcgtcgcagcaccaagaagcccaccgatttcctcaatgatttccctcctcttcccaactccattttccagaactacccaatgattgccagagagtacgaacgtgtgagagctggaaggcctcccgttgctcttgatagatcgcgctacgatttggaaatgccgccgcccaataaaaggaacgacgaaactgcttggaagcaagctcttcatagagctcaacgcctgctgcaatatcagatcatcaggatggaaaatttggacttgatgttaaaatatggtcccgatacctggaaacagcacaaccagagattggaagtatacttgtcaagaatgcagaaattagctcaggaacaaaatgaaaagattgaaaaagtaaaccgtgaaaggaaatatcatcagcaaaacactgcatatgagcttaatgcgttgtccatgcaatggaaggagctttgtcagaagaatatagacatcagtgctgcctgtgcttcagttgaaaatcgcataaatgaactgaaaagagaagcagcagaaaggctggaacttgggagctgtaacagaaaatga

SEQ ID NO: 3366 - DNA, 705 bp, Glycine Max
atggcggatggaagcagcggggaaattctaatgctggaagccccagcgtcttacggtaggtctagcgattccgacgcggaaataatcgacgcattgccttatatcgacgacgactacgcagaccccagagtcaaactggaggttgaccgtctcgtggaggatgagatgcgtcgcagcaccaagaagcccaccgatttcctcaatgatttccctcctcttcccaactccattttccagaactacccaatgattgccagagagtacgaacgtgtgagagctggaaggcctcccgttgctcttgatagatcgcgctacgatttggaaatgccgccgcccaataaaaggaacgacgaaactgcttggaagcaagctcttcatagagctcaacgcctgctgcaatatcagatcatcaggatggaaaatttggacttgatgttaaaatatggtcccgatacctggaaacagcacaaccagagattggaagtatacttgtcaagaatgcagaaattagctcaggaacaaaatgaaaagattgaaaaagtaaaccgtgaaaggaaatatcatcagcaaaacactgcatatgagcttaatgcgttgtccatgcaatggaaggagctttgtcagaagaatatagacatcagtgctgcctgtgcttcagttgaaaatcgcataaatgaactgaaaagagaagcagcagaaaggtga

SEQ ID NO: 3367 - DNA, 1776 bp, Glycine Max
atggcggcagaaaagggtgttgagatggtggcattggagtgtttgggaaaagggttcgatttggccagcgattttcggttgaggttcgcaaagggaattcgtgaagagaggttggtggtgcttgatgaacagaacaagagggatattttgattcctggaactggaggagttaccattaaaggggtttctgagaatattcgttgtgataaaggggatagaatacgcttcaagtctgatgtacttgaattcaatcagatgtctgagttgcttaatcagaaatcagcagtgcaagggaaagttccttctggctattttaatgcgctctttgatttgagtggggattggtttcgtgatgctgctgacaccaagtaccttgcttttgatgggtatttcatttcactctactatttgcacctcactgcttctccactcatactgcaagaggaggtaaagaagtctgttccggctcggtgggatccggcttcgttgtctaggttcatccagacatatggtacacacataatagtgggtatggctgtaggaggtcaagatttaatctgtgtcaaacaaaaacattcttcaaagattcctcctggtgatctcagaagacatttggaggatcttggagattttttattctcagatgtccctgaggtctttaaccgtgtgatgcaatcaaacacgatgcagttcactagtatttcagaaacatcaagcaaggatggcctcactattatttgctcaaaaagaggaggagatatgttcaagcacagccactcaaattggcttcagacagtgccgtctaaccctgaagcaatcctcttcaagtttgttcctatttcctcacttctgacaggaattcctggaagtggatatcttagtcatgcaatcaatctgtatctacgctataagccttctcctggagatttacaatactttttggagtttcaaattccaaggcaatgggcacctatgttttgcgagctgcctctcaggcatcagcgtagaaagactgcttccccttccctgcaatttagtttcatgggtccaaagcttcatataatctctacacaggtggtaagtgaacagaaacctgtggttggcatgcgcttgtacttggagggcaggaaatgtgacagacttgctttacatataaatcatctttcaagcctcccaaataaaatgatcctctcgtcaggaacctcaacctcgagtacaccatcgatgtggcgaggatctgatgataatgaatccagtgaacaatttctggaacgtatcagatggaagagattctcaaatgtgtgcacagcagttgttaagcatgaccctaactggttgattaattctggaggtgtttatattgtaacaggtgcacaactccttagcaaagggagctggccaaggaatgtgcttcatctacggcttctctttactcatatacccaattgcagtatccggaagtcagagtggactgctgcaccagaggcttcaagaaaatcttttctcacaaatttgagcacaacattttcgttcactcagcatggcaccaccggtcctccaaaacaggctccaactgcacttaactctggagtttatccagatggtcctcctgtgccagttcgcgccggtaaactacttaaatacgtggagacagctgaggtcgtgcgaggcccacatgatgctcctggccattggttggtaacagctgctaagcttgtgactgatggtggtaagattggattacaagtgaagtttgcattgttagattattggtga

SEQ ID NO: 3368 - DNA, 1608 bp, Glycine Max
atggcggccctcggtagatcctccgctgccgccaccacctccctctcctcctcctccgcccgattccgccgctccctccacctaccgccttcccaactctccttcccgcgcgcgcgcttttccgtcaacgccacgtgccccttcttctccgataacaatggcaataagatttcccttccccaagacgtcgtcgcttccaaaccctcccctctcgagttgctcaaaacttccgccgccgacagatatacgaaggaaaagagtagcattatttgcatagggctgaacattcacactgctcccgttgagatgcgtgagaagctttccattccagaatcgcattgggctcaggtcatcaaggacctttgcgctttgaatcacatcgaagaagccgcggttctcagcacgtgcaatcgcatggaaatctatgttgtggctctctctcagcaccgtggtgttaaggaggttactgattggatgtctaaggtgagtgggatttcaatacctgagcttcgggagcaccaagttttgctgtataacgcgtacgccgcgcagcatctatttgaagtggcgtcagggcttgactcacttgttcttggggaaggtcaaattcttgctcaggtgaagcaggttgtgaaagctggacagggagtgcctggttttgataagaaaatcagtggtttgttcaagcaggcgatatcggttgggaagcgggttagaaccgagactaacatttcatctggatcagtttctgtaagctcggctgctgtggagcttgcactgatgaagctaccggattcctcctttgctgattctggagtgttggtggttggtgctgggaagatggggaagcttgtgattaagcatttggctgccaaaggttgcagaaagatggttgttgttaacaggactgaagagaaagttaatgccattcggaaagagttgaaggatgttgagattctgtttagaccaatttcagatatgctggcgtgtgctgccgaagctgatgtgatcttcaccagcacgacgtctgaatcatcgttgttttctaaagagaatgtgcagatgcttcctctggttagtcatgggagaaggcggctttttgttgatatatctattcctaggaatgtggaaccgagtgtctcggatctggagactgcacttgtgtacaatgtggatgatctgaaggaagttgttgcagctaacaaggaggacaggcttcagaaagctgaggaagcccgaggaattatactagaggagttgaataaatttgaagcgtggaaagactctctggaaactgttcctactattaagaagtttagagcttatgttgagaggataagagcctctgagatggagaagtgtttgtcgaagatgggccctgatgtctcaaagcaacacaaagatgcaatttatgcccttagtatgggtattgtgaataagctacttcatggtcccatgcagcacctaaggtgtgatgggaaaaatgatagtagtctgagtgaagtacttgagaatatgcgcgcccttaacagaatgtatgatcttgagacagaaacttccttgatcgaagaaaagatcagagtcaagatggaacgggttcagaagtag

SEQ ID NO: 3369 - DNA, 1428 bp, Glycine Max; identical to SEQ ID NO: 424

SEQ ID NO: 3370 - DNA, 939 bp, Glycine Max; identical to SEQ ID NO: 425

SEQ ID NO: 3371 - DNA, 2238 bp, Glycine Max
atggcggctagcagacatggcggttaccgcgaaaacgagttcaaagagcgcgaatcaaagttagaagtttccagacgcggattcgcgaattcgaaagaggattacgatcgtgttaggaatggtggtggcggtgaagttgtgaggggtgggtcaagggatagggttagggtgaggcagaaggatattaaggagagggaaggtgttaatggtggtggttatcgatcctcttcgagtaggagtgactctggcagcagtggccttggtcctcgccggtgtggtttctctgtcaaggcagttgatagagagcctggtgagctttccagtgagagtggttctgatgatgctattgaatcggaaccggggttaaaaggctccgaggttgcaatgttggaagaaaccaggactctgtctccgccagtgccggagagaaaaaggaagttttcgcccatagtgtgggatcaggatgacaaggaagtcaacgagctatccaaagttagggtttccgcctctgcggtgaaggtggctgcgcttcctcctccacctccgttgcctaaggtgttccgtcagtcacagtcgccgaatgctccgaatagtggagttgaaatagttcctgtcaagaacagggaaactgaggaacttcagttgaatgcagcatctaatgttaccttgtcctctccttcaggtttgcattcattgcccccaaaagggaagtgggataatgatcaggaagctgagcatccagaaggcgaagattatgttccaactcgcaatatatcgtcttcaagatgggcagctggagataactctcctgttgatgagggtgagatcctcaatgatgaggaaatgcccaaaagtaggtggagggtgtctcctgatttattggatggtaggctaaggaacaagctattgagccctgaggaatctaaggtagaaggtattgaaagagctagagccagatcatctgaatctgaagaaagaggtgcccgtgggagaacttccagtggtgatgattaccccgggtcagagaaggatgactacatggaggttgatgttcaaggtgggaaaagtgaaaccagtatcagtcactcagacacggattctgaagatgaagatgatggccgggagactccagaacctactgctcaacctcaaagaacattcaacatgcttcagggttgtagaagtgttgatgagtttgagagactcaacaagatagatgaaggaacatatggtgttgtatatagggctagggataaaaagactggagaaattgtagcattgaagaaggtcaagatggagaaggaaaaagagggcttcccactgacttctctcagggaaataaacattcttctttcttttcaccacccatacatagttgacgttaaagaagtagtggtaggaagtagccttgatagtattttcatggtcatggaatatatggaacatgaccttaaaggactaatggaggcaatgaagcaaccttttagccagagtgaagtgaagtgcttgatgatccagcttttagaaggtgtgaagtatcttcacgacaactgggtgcttcatagggatttgaagacttcaaaccttcttctaaataataggggtgagctcaaaatttgtgattttggcttggctcgtcagtatgggagtcctttaaagccatacacacacctggtggtaactctttggtacagggcacctgaacttcttctgggggcaaaacagtattcaacagccattgacatgtggtctttaggttgtataatggctgagctattgtctaaggaaccactgtttaatgggagaacagagtttgatcaacttgacaagattttccggattcttggcacaccaaatgaaacaatttggcctgggttctccaaattacctggagtcaaggtcaattttgtcaaacaccagtacaatctcctgcgtaaaaagtttcctgccacatcattcactggatctcctgttctttctgattctggatttgatttgttgaacaagcttctaacttatgaccctgagaagcggatcactgccgaagatgctctaaatcatgagtggttccgtgaagttcctctccccaaaagtaaagaattcatgcctacatttcctgctcaacatgctcaggacaggcgtgtgcggagaatatacaagagtccggatcctttagaggagcagcgtcggaaggagttgcagcagggtgaaacagggactggtgggatttttggctaa

SEQ ID NO: 3372 - DNA, 2238 bp, Glycine Max; identical to SEQ ID NO: 3371

SEQ ID NO: 3373 - DNA, 387 bp, Glycine Max
atggcgggcaaaggtgttggttcagtggctaaggcagtagcagaatatcagtatccttggcgtgagaagttggcgaaatataaggatgagtttgctaagggtgtgtggggatactgggagctgggggcatggaagccgctgagcatcggtgctcggcatcgcgctagaattcgcaaggaagtcctccttgctggggaagattggccgtatgatcctgaaaggaaggagatgaagaccaggaggaaaggacacaaatgtgataggatatccgctgagaagcgcgcaaacactgccaagttgatggagaagatgccccagatgttgctggattacaagaagagaaggtggcagaagaagatgaaggaggaagacaagggaaaactttga

SEQ ID NO: 3374 - DNA, 387 bp, Glycine Max; identical to SEQ ID NO: 3373

SEQ ID NO: 3375 - DNA, 402 bp, Glycine Max
atggcggtgcctctgctctcaaagaagatcgtgaagaagagggtaaagaagttcaagaggcctcagagtgacaggaaaatttccgtcaagactaactggcgcagaccaaagggtatcgattctcgtgttaggagaaagttcaagggatgcactttgatgccaaacattggttatggttcagacaagaagacccgccactatctccctaatggtttcaagaaatttgttgttcacaatgtgaaggatttggaactgctcatgatgcacaacaggacttactgtgctgagattgcccacaatatatccacaagaaagagaaaagatatagtcgagagagccgcgcagcttgatgttgttgtgacaaacaaaacggccagattacgcagccaggaggatgaatag

SEQ ID NO: 3376 - DNA, 402 bp, Glycine Max
atggcggtgcctcttctctcgaagaagatcgtgaagaagaggctgaagaagttcaagaggcctcaaagtgacaggaagatttctgtgaagacaaactggcgcagaccaaagggtatcgattcccgtgttaggagaaagttcaagggatgcactttgatgccgaacattggttatgcttcagacaagaagacccgccactatctcccgaatggtttcaagaaatttgttgttcacaatgtgaaggatttggaactgctcatgatgcacaacaggacttactgtgctgagattgcccacaatatatccacaagaaagagaaaagatatagtcgagagagccgcgcagcttgatgttgttgtgacaaataaaacggccagattacgtagccaggaggatgaatag

SEQ ID NO: 3377 - DNA, 1191 bp, Glycine Max
atggcggtggagtacacatgctgctcaacggccttcttcgttcacatactggtcatcgtgctgctcgtgcttttcgcgggcctcatgtcgggcctcaccttgggcctcatgtcgctcagcctcgttgatcttgaagttcttgctaagtctggtactcctcaggatcgtaaacacgctgagaagatattaccagttgtcaaaaaccaacatttattgctatgtactctgctaatttgcaatgctgcagccatggagacacttcctatttttcttgatggccttgttactgcatggggcgctatcctaatttctgtgacattaattcttttgtttggtgagattataccccaatcagtttgttctcggtatggtttggctattggtgcatcagtggctccctttgtccgtgtgcttgtatgcatatgttttccagttgcctatccaattagtaaggctggaaaagggggggaactgacacatgatgaaacaacgatcattgccggggcacttgaactcagtgagaagacggcgagtgatgccatgactcctatatctgaaacatttactgttgatattaattcaaagcttgatagggaactgatgaatgagatattggagaaagggcacagcagagtcccagtctattatgagcagcctacaaacattattggacttgtactggtcaagaatttattgacagttcatccagaagatgaagcacccatgaagagtgtaaccatacgcaggattccaagggttccagaaagtatgccactttatgacattttgaatgagtttcagaagggccatagccacatggcagttgttgtcagacggtgtgacaagactaaccaacaatcttcccaaaataatgcaaatgactcggtgagagatgttaaggtggatattgatggtgaaaagcctcccaaagagaaagctttgaaacccaagatgccactccacaagtggaaaagctttccaaatacaaacaagtcatcaaataggggttctcggagcagaaaatggtcaaaaaatatgtactcggatattttggagatagatggaagtccccttccaaagctccctgaagaagaagaagccgttggaattattaccatggaagatgtcattgaagagcttttacaggaggagatctttgatgagacagatcatcattttgaagactcataa

SEQ ID NO: 3378 - DNA, 1278 bp, Glycine Max
atggcggtggagtacacatgctgctcaacggccttcttcgttcacatactggtcatcgtgctgctcgtgcttttcgcgggcctcatgtcgggcctcaccttgggcctcatgtcgctcagcctcgttgatcttgaagttcttgctaagtctggtactcctcaggatcgtaaacacgctgagaagatattaccagttgtcaaaaaccaacatttattgctatgtactctgctaatttgcaatgctgcagccatggagacacttcctatttttcttgatggccttgttactgcatggggcgctatcctaatttctgtgacattaattcttttgtttggtgagattataccccaatcagtttgttctcggtatggtttggctattggtgcatcagtggctccctttgtccgtgtgcttgtatgcatatgttttccagttgcctatccaattagtaagttattagattttttgctgggccatcgacatgaagccctattccgtagagctgagttgaaaacactcgtaaatttgcatggtaatgaggctggaaaagggggggaactgacacatgatgaaacaacgatcattgccggggcacttgaactcagtgagaagacggcgagtgatgccatgactcctatatctgaaacatttactgttgatattaattcaaagcttgatagggaactgatgaatgagatattggagaaagggcacagcagagtcccagtctattatgagcagcctacaaacattattggacttgtactggtcaagaatttattgacagttcatccagaagatgaagcacccatgaagagtgtaaccatacgcaggattccaagggttccagaaagtatgccactttatgacattttgaatgagtttcagaagggccatagccacatggcagttgttgtcagacggtgtgacaagactaaccaacaatcttcccaaaataatgcaaatgactcggtgagagatgttaaggtggatattgatggtgaaaagcctcccaaagagaaagctttgaaacccaagatgccactccacaagtggaaaagctttccaaatacaaacaagtcatcaaataggggttctcggagcagaaaatggtcaaaaaatatgtactcggatattttggagatagatggaagtccccttccaaagctccctgaagaagaagaagccgttggaattattaccatggaagatgtcattgaagagcttttacaggaggagatctttgatgagacagatcatcattttgaagactcataa

SEQ ID NO: 3379 - DNA, 984 bp, Glycine Max
atggcggtggagtacacatgctgctcaacggccttcttcgttcacatactggtcatcgtgctgctcgtgcttttcgcgggcctcatgtcgggcctcaccttgggcctcatgtcgctcagcctcgttgatcttgaagttcttgctaagtctggtactcctcaggatcgtaaacacgctgagaagatattaccagttgtcaaaaaccaacatttattgctatgtactctgctaatttgcaatgctgcagccatggagacacttcctatttttcttgatggccttgttactgcatggggcgctatcctaatttctgtgacattaattcttttgtttggtgagattataccccaatcagtttgttctcggtatggtttggctattggtgcatcagtggctccctttgtccgtgtgcttgtatgcatatgttttccagttgcctatccaattagtaagttattagattttttgctgggccatcgacatgaagccctattccgtagagctgagttgaaaacactcgtaaatttgcatggtaatgaggctggaaaagggggggaactgacacatgatgaaacaacgatcattgccggggcacttgaactcagtgagaagacggcgagtgatgccatgactcctatatctgaaacatttactgttgatattaattcaaagcttgatagggaactgatgaatgagatattggagaaagggcacagcagagtcccagtctattatgagcagcctacaaacattattggacttgtactggtcaagaatttattgacagttcatccagaagatgaagcacccatgaagagtgtaaccatacgcaggattccaagggttccagaaagtatgccactttatgacattttgaatgagtttcagaagggccatagccacatggcagttgttgtcagacggtgtgacaagactaaccaacaatcttcccaaaataatgcaaatggtaaaaacatgctataa

SEQ ID NO: 3380 - DNA, 2445 bp, Glycine Max
atggcggtggcgggcggcgccgctcctctcggctcgtcggtgatctcgctggtgaaccggctccaggacatcttcagtcgcgtggggagccactccgccatcgacctccctcaggttgcggtggtcggcagccagagcagcggcaagtccagcgtcctcgaagccctcgtcggccgtgacttcctccctcgcggcaacgacatctgcacgcgccgccccctcgtcctccagctcgtccaaaccaaacccccttctcaggatgagttcggcgagttcctccacttgcctggccgcaagttccacgacttctcccaaattcgcgccgaaattcaggttgagactgatagggaagctggagggaacaaaggtgtgtctgataaacagattcgtttgaagattttttcgccgaatgttctcgacattacgctcgtggatctccctggcatcaccaaggttcccgttggcgaccagccttcggatatcgaggctcgaatcagaaccatgatcatgtcttacatcaaaactccaacctgtgtcattctcgctgtgacgccggcgaattcggatttggcgaactcggatgctcttcagatggctggaattgccgatcctgatgggaacagaacgattggtgtcatcacgaagttggatatcatggatagaggcactgatgcgcggaatctgttgctaggaaaagttattcccctccgacttggttatgtcggtgttgtgaatcgtagtcaagaggatattctaatgaaccgaagtataaaggatgctcttgttgctgaagagaagtttttccgcactcatcctatatacagtggcctagcagatagttgcggtgttcctcaattggcaaagaagttgaacaagattcttgcacaacacatcaagtctgtgttaccagggctgagagcacgtataagcgcttcactagtcactattgcaaaggaacatgcaagctatggagaaatcacagagtccaaggctggacagggtgctcttctccttaatattctttcaaaatactgtgatgcattctcctccatggtagagggaaagaatgaggagatgtctacatctgagctgtctgggggtgcaagaattcattacatttttcaatccatctttgtgaagagcttagaggaggtggatccatgcgaagatttgactgatgatgatattcgcacagccatacagaatgcaactggacctaaatcagcactgtttgttcctgaagtcccgtttgaagtgcttgtacgcaggcagatatctcgactattggatccaagtcttcagtgcgctaggtttatatatgacgagttaatgaaaatcagccatcactgtatggtcactgaattgcagcggttccctttcttgagaaagcgcatggatgaagttattgggaactttttacgagaaggcctagaaccctcggagactatgataacacacgtcatagaaatggagatggactacatcaacacttcccacccaaattttattggtggaagtaaggcaatagaagctgcagtgcaacaaaccaggtcttctagagttggtttaccagtttctagggtgaaggatgcactggaatctgataagggaccagctactgagagaagtgggaagtctcgatctattcttgcaagacatgcaaatggagtagtggctgatcagggtgttcgtgctacatcagatgttgaaaaagtagtgacctctggaaacacaggtggatcaagttgggggatctcatccattttcggtggaggtgataaccgtgtgtctgtgaaggaaatgacagctagtaaaccacatactactgaaccaatgcataatgtgcagtcattctctacaattcatttgagagagcccccttctgtcttgagaccattggagagcaattcagagaccgaagctgttgaaatcacagtaacaaagttgcttttgaaatcatactatgacattgtcaggaaaaatgttgaggatcttgtccccaaagcaattatgcacttcttggtaaataacacaaagagagagcttcacaatgtcttcattgaaaaactatacagagaggatctgtttgaagagatgttgcaagaacctgaagaggtagccaagaaaagaaaaaactgtcgagaactgctccgagcttatcaacaggcttttaaagacttgaacgaactgcctcttgaagctgaaacagttgaaaggggatacagtttgcctgaaattactaccggcttacctaaaattcgtggattgccaacttcatctatgtattctactagcagttcgggagactattatgaagcttctcccaagaacacaaagtctaaaaataaaaagtcttcacattctggggaactccaatctccatttcaggattcaaacggaaatggagggccatacacgtcaggttatccaatggctggtgaatga

SEQ ID NO: 3381 - DNA, 1638 bp, Glycine Max; identical to SEQ ID NO: 426

SEQ ID NO: 3382 - DNA, 372 bp, Glycine Max
atggcgtatctgagattctcacacgcagcaccacagccacacctcacactagggtttccttcaccacctcaatttctctctattgctgctccaaaattctctccctcgtcttctaccatcaggtgcaaaggttttagtagattgatagtgaatcagaggctggtgactgtttttgcaacaaatcccaactctgtaggtgaaaaatcacccacagaaggatcagatgtaaatgaaactagcaatgctgctcaaggacctcctctccttactattctggctggattctttgtcctttttgttgtttgttggagcatttggtccattataacgtggctgataagtttaatagttaatgtacctgctccaaaataa

SEQ ID NO: 3383 - DNA, 1668 bp, Glycine Max
atggcgtccctgaccccgggcgtcctctcgaagctcctggacaacgcgggttccaaggtaaccgccgctcaccggcaggccctcctgcaggtgacggagatcgtgccgcgcctctcctcaacctccccattacagagccgcggctactttttaaaactctcggactccctccactccgcctacgtctccgtccccgacgccgacgccgacctcatctgcgccggcaagctccacctcggccagttcgtctacgtcacacgcctcgacgccgcctcccccgtcccccttgtccgcggcctcaacgtgctcccccgccggaggccctgcgtcgggaaccctactgagttggttcccagcgagaggctttgcgtcgccactccgaagaaaaagaagagagaagaggttgttaagaaggagaaggggttggagatgatgaggaggttgagtttggattcttctagaagggtttgggatcagagtccggccaagaagtctaactctaaccccacttcgcttaacggttttatattagttgtttctttctttttaggggggaatgggcgtcttcgtttagcatcaaatttgatggcgggcacgtttttaagaaaacactttctgatgttgtatgagacaaaagacaagaaggttgtttctgtcaaacctgattctccactaaaatctccaacatcaagtgtctcacccttgaagaataaaaacgagaacctgtgtccaaaatcattgacaatcacacctccgaggaagacccacttgttaaggtccccctcaatttcaagacttggtgttatgatactcctgcatgttgggaagatgtctcactccccatgtcaagttgtgactcatagaactgttgcctttttagcggctgtgcggtctcttgaagaagcatctgctacagattctgtgatccaatgcatgtgcatgtatgcagaactttgccagtctggtcaaacacattctcctggatcacttgtgaagcagtttttggagcttcacctgagtttgcagagagtaacagtgctgtttgattcgttactcaacccacttcctgaaacaaagtcaagcagccactctaccctacagtgtctaacagaagatgcatgcaaagttcccacccgaaagaatgctatatcttgggtacaagctgccgtaggtaccaatctttccaaattcaatctatttgaaacacaggcgaaaagtgaggttctaaatggtgagaaatgtcattatgttgtcattgagaatactcccgaggacatcaatactgagacttcacctgctcaaaacaagcaaaatcgtcggaatctcttggcagcaaagaacaaggatgctgacaaacatgatcgatcaaaagaaatcaaattaaaagaggctgcgagtttggcagaaaaactgcttgaggcatctagcgaatggttcctgaagtacttggaggagtctctgagtaatgagttcgggttgaaaaatgaagggaacactgaaattgcaagtcttcttggacaactcaaacaggtgaatcactggttagataatttggctggtggagataaggttgatcaccgggtagagaagctaaggaaaaatttgtaccggtttctacttgagcatttggcgactcttaacatgctgcggtgcagaatgttttggtaa

SEQ ID NO: 3384 - DNA, 720 bp, Glycine Max
atggcgtcgtcgaaggttgtctcgacgaatccggatctgccacgaaactcttcttcgtcgtcgtcttcttcatcaacttctcctatatctcccctttcttctcttctctccgatctgcacccaatggacgacattctcaagtccatcagccccaagtcggtcgacgacgtctggaatgacatcgttaccggcgccaccgtccacgacgccgtctctgccaccactaccgacaatgccgacgccgccatgaccctcgaggatttcctcaccaaggccataagagaggaagacgtcagaggggctcctcctcctcctcctcctcctcctccttcttcctttctccccttccctgccgatggctcttcctcctccgttgagcctttcgccaatggcgttagtgccgcgccgtcgaattcggttcagaaagggaagagaagagccgtggaggaaccggttgacaaggcaacgcttcagaagcagaggaggatgatcaagaatagagagtctgctgctaggtccagggaacgcaagcaggcttacacatctgagcttgagtatctggttcaccagctagagcaagagaatgtgcagttattaaatgaagaggctgagatgagaaggcagaggaaaaagcagcttttcgagtgcatcattccaattgaggtgatgcctaaaccgaagaaaaaacttcgaagagtaaattcagcacaatcattgtga

SEQ ID NO: 3385 - DNA, 2751 bp, Glycine Max
atggcgtcgttttccgccgccgtcgctcagttctcccgcgtttcaccttctcacacttcgctccactctcactctcacggcacgctcttccaatctcaatgccgccctttcttcctctcgcgcacttcccattcactccggaagggtcttactttaccacggggaagagaggcaccgagtacatctgtacgtgcttcatttacagatgtttcaccgaatgtgtccttggaggaaaaacaactacccaaaggagaaacttggtctgttcacaaatttggtggaacctgtgtgggaacctctcagagaataaaaaatgttgcggacataattcttaaggatgattcggagaggaaattggtggttgtttctgcaatgtcaaaggtgacagatatgatgtatgaccttatccacaaggctcaatcacgcgatgagtcttatacagctgcattaaatgctgttttggagaagcacagtgcaactgcacatgacatacttgatggagataatcttgctactttcttgtctaaattgcatcatgatattagtaaccttaaggcgatgcttcgtgcaatatacatagctggtcatgcaacagagtcctttacagattttgttgtgggacatggagaattatggtctgctcagatgttgtctctagttattaggaagaatgggactgattgcaaatggatggatacaagggatgtccttatcgtaaatcctactggttctaatcaagttgatcctgactatttggaatctgagcaaagacttgaaaaatggtactctttgaatccatgtaaggtaatcattgccactggattcattgcaagcacacctcaaaacattcctaccacactgaagagagatggaagtgacttctcggcagcaattatgggtgctctatttaaggctcgtcaggtcacaatttggacagatgttgatggtgtgtatagtgcagatcctagaaaagttagtgaggctgtgattttgaagacactgtcttatcaagaggcttgggaaatgtcttattttggtgccaatgtcttgcatccccgcacaattattcctgtgatgcgatatggcatacccattatgataaggaacattttcaacctttctgctcctggaacaaagatctgccatccttctgttaatgatcatgaagatagccagaacctgcaaaattttgtcaaaggatttgcaaccatagacaacttggcacttgtaaacgtcgagggaactggaatggctggtgttccaggtactgccagtgctatttttggtgcagtaaaagatgttggagctaatgttatcatgatatctcaggctagtagtgagcattctgtatgctttgctgtgcccgagaaagaagtaaaagctgttgctgaggcattgcaatctagatttcgtcaagctttggataatgggcgtctttctcaggttgcagtcattccaaattgtagcattctggctgcagttggccagaaaatggcaagcactcctggtgttagtgcctcccttttcaatgcattggctaaggccaatataaatgtccgtgctatagcccaaggttgttctgagtacaatattactgttgttgttaagcgagaggattgtataaaggctttacgagctgtccattccagattttatctctcaagaaccaccatagcaatgggcattattggacctggattaattgggagcacactacttgagcagctaagggatcaggcctcaaccctaaaagaagaattcaacatcgatttgcgtgtaatgggcatacttggttcaaagtcaatgcttcttagtgatgtgggcattgacttagctagatggagagaacttcgagaggaaagaggagaagtggctaatatggaaaaatttgttcaacatgtacatggaaatcattttataccaaacacggcattagtggactgcacagctgactctgtcattgctggctattactatgattggttgcgcaaaggaatacatgtagttactcctaacaagaaggcaaattcaggaccacttgatcagtatttgaagttaagagctcttcaaaggcaatcctatacacattacttctatgaagcaactgtcggagctggtcttccaattgttagcactttacgtggcctccttgaaactggagacaaaatattacaaatcgaaggcatctttagtgggactttgagttacatatttaataactttaaagatggccgggcttttagtgaggtagtttctgaagcaaaggaagcaggttatactgagccagatccaagagatgatctgtctggaacagatgttgccagaaaggttataattcttgctagggagtcgggtttaaagctagaactgtctaatattccagttgaaagccttgtgccagaaccactacgagcttgtgcatcagctcaggagtttatgcaagagctaccaaaatttgatcaggagttcacaaagaaacaagaagatgctgagaatgctggggaagtcttgagatacgttggagtggtggacgtgactaataaaaaaggagtggtagagctgcgaagatacaagaaggatcatccctttgcgcaattgtctgggtcagataacattattgcatttacaacacgaaggtataaggatcagcctctgatagttcgtgggccaggagctggtgctcaagtcaccgctggtggaatatttagtgatattttacgacttgcctcatatcttggtgctccatcgtaa

SEQ ID NO: 3386 - DNA, 1035 bp, Glycine Max
atggcgtcttcgatcgcagctggtgctggatccaccgatcccacagctgccagaagaaacactaagcgacccaagtattcaaagtttactcagcaagaacttccagcgtgtaagccaattctcacgccacgagcggttatttcggcattcttgcttgtcagcattgtattcgttcctattggagttgcttcactaattgcttcaaggaaggttgttgaaattgtttctaggtatgaatcaacatgcataccagatggtgttactgacaaggtagcatacattcagagtcctgcagataaaacatgccacatatcactacctgtgcacaagcatatgaagtcgcctatttatgtctactatcaacttgacaacttctaccaaaatcatcgccgatatgttaaaagccgaagtgatgagcaattgcgggatcatagggaagagaactcaacaaatgcttgtaagcctgaagatatagccaatggaaaggcaattgtaccttgtggtcttatagcttggagtttattcaatgacacatacagtttctcccgtgacaacaagaatttgactgtgaacaagaatggcatctcctggaagagtgatagagagcacaaatttggaaaagatgttttccccaaaaacttccagagtagtgctattagaggtggtgcaactctcaatgtatccataccattgagtaagcaggaggatcttattgtctggatgcgaactgctgctttgccaacttttaggaagttgtatggaaagatagaggtggatctgaatgaaggtgataacataactgtgacactgcaaaataactacaacacgtacagttttaatggcaagaaaaagcttgttctgtcaactactagctggcttggtgggaagaatgacttccttggcattgcctatctcactgttggaggattgtgcttctttttggcattggcttttaccattgtatattttgtcaagccaaggcaacttggagatccctcatatttgtcatggaataggaatccaggagggcgctga

SEQ ID NO: 3387 - DNA, 1035 bp, Glycine Max; identical to SEQ ID NO: 3386

SEQ ID NO: 3388 - DNA, 984 bp, Glycine Max
atggcgtcttcgatcgcagctggtgctggatccaccgatcccacagctgccagaagaaacactaagcgacccaagtattcaaagtttactcagcaagaacttccagcgtgtaagccaattctcacgccacgagcggttatttcggcattcttgcttgtcagcattgtattcgttcctattggagttgcttcactaattgcttcaaggaaggttgttgaaattgtttctaggtatgaatcaacatgcataccagatggtgttactgacaaggtagcatacattcagagtcctgcagataaaacatgccacatatcactacctgtgcacaagcatatgaagtcgcctatttatgtctactatcaacttgacaacttctaccaaaatcatcgccgatatgttaaaagccgaagtgatgagcaattgcgggatcatagggaagagaactcaacaaatgcttgtaagcctgaagatatagccaatggaaaggcaattgtaccttgtggtcttatagcttggagtttattcaatgacacatacagtttctcccgtgacaacaagaatttgactgtgaacaagaatggcatctcctggaagagtgatagagagcacaaatttggaaaagatgttttccccaaaaacttccagagtagtgctattagaggtggtgcaactctcaatgtatccataccattgagtaagcaggaggatcttattgtctggatgcgaactgctgctttgccaacttttaggaagttgtatggaaagatagaggtggatctgaatgaaggtgataacataactgtgacactgcaaaataactacaacacgtacagttttaatggcaagaaaaagcttgttctgtcaactactagctggcttggtgggaagaatgacttccttggcattgcctatctcactgttggaggattgtgcttctttttggcattggcttttaccattgtatattttgtcaagccaaggtaa

SEQ ID NO: 3389 - DNA, 558 bp, Glycine Max
atggcgtgcaggggtatgcttcgttccaccattctcatagaacccagcctactccgttctttaaatttcaattctaacaaacatcacatagcttcactcaaccaatggtcttgccggtttcattctccaaaacccccttattcttcctctcagaacgaaacgccgttgtctcaggaccctgtcttgaaggccatttcagagatttccaaaggcgaagggagggttggccaaacaacaaacgtaattattggaagcactgctgccgatgattctaacaatgaatggttggctttggaccagaaggtgaactcgtacccaaccgatcgaggatttaccgccattggaactggaggtgaggattttgtgcaagccatggttgttgctgtcgaatctgtaatccaacaaccaattcctcagggatatgtgaagcaaaagttatcgtcggggggcaaatatgtatctgtaaatattgggcccattcaagttgtttctagtgaacaggtccaagctgtatataatgccatgaggacagacaaccgggtgaaatattttttataa

SEQ ID NO: 3390 - DNA, 558 bp, Glycine Max; identical to SEQ ID NO: 3389

SEQ ID NO: 3391 - DNA, 468 bp, Glycine Max
atggcgttagggtttgagggttatagttatacaacaacacttggaaggaaaagggttgtgttattacacagtgaagcttcttctctcaactccaattcaccggtgaattcattgaagagaatgtgtagcaagaaattcacatttgactctgaaaggtctcgccttgaggcccttcctcttgatgttctgataagggtgttgtgtggtgtcgatcatgaagatttgaagcaacttgttcgagtctcaaaaactgttagagaagcggctgaggttgctaggaggatgcattttgagtatagcactccaaagaagaaaaattttgctattcctaaaccgtttgatatagagggtgctggtgggtttgaggaaattgatactccaaaagccccatcgaagaaagctaagtcaaagctgattggtaagaatctagcaagcatctcagtggcattgtttgcttcccctaattag

SEQ ID NO: 3392 - DNA, 2562 bp, Glycine Max
atggcgttcgggtcttccgaggatgtctcaggtgtcaaattacttgtccttctggcggtcatgtacggactcttgtcggcgctgacatactccgtcatccacatgaagttcgtcaaccctctcgggaacgacgcgccgtttgatcgattctccgaagccagaactgtagaacatgttcgaatgttgtcgcaagaaatcgacggccgtcaagaagggcgtcctggattgaaaaaggcagcacaatatattaagcgtcagttggaagtaataaaggagcgagctacctccaatgtcagaattgagattgaggagacaactgtgagtggctccttcaatatgttgtttttgggccataacatagctctgggatacagaaatcatactaatattcttatgaggatatcatctgtggattccaaagagactgatccatccgttttagtgaatgggcattttgatagtccccttggttcccctggtgctggtgactgtggttcatgtgttgcatctatgctggaaattgcaagactaattgttgactctggttgggctccctaccgcccagttattttcctttttaatggtgctgaggaactttttatgttgggtgcacatggattcatgaagacacataaatggcatgacactataggagcttttataaatgtggaggcatctgggactggagggcctgatttagtttgccaatctggacccagttcttggccttctaatgtctatgcagaagcagcaatataccctatggctaatagtgcagcccaggacgtttttcctgttattcctggagatacagattaccgaatattttcccaagactatggggatattcccgggcttgacattatctttctccttggtggttatttttaccatacctcctatgatacagtagagagactattacctggaagcatccaagcacgtggagaaaatctgttcagcataatcaagacttttactaattctgctaatatacagaacacctataaaaaaaaatctagtgaagttactgctagcacattcaacgatgagcgggctgtattctttgattatttctcatggtttatgatattttatcctagatgggtagctaaaattcttcacagtattcctgtcttcttctttcttgtcatgcccttcactcatggatttatgttccatgcggttgggattatattggccgttggtgttcctgttgcattttctattctgagattactgttctcttctcaaacaatgaattggtttgctcatccatacttggctttcgcaatgtttgtaccttgtgcacttgttggacttttaattccaagaataatctggagacactttcctctttctcaagatatttccattgtcaagacatcaaaagaggcactatctgatgaagcaaggttctggggagcatttgggttctatgctgtattaactttggcttatcttgtagctgggttgagtggaggttttgtgaccttttttgtttgtgcttccctgcttcctgcatggatatcgttctgcttgtcagtcaaattctttggacaacggtcactcaggtcaacaatgttttacatactacctctagttccatgccttgcgtattctgtttattttggtggctttcttgcccagtttctgatagagaggatgggaatgatgggttctcttccactaccatatgggcactatgttcccgatgttattgtggctgcattaattggaactgtaactggttggtgcacaggccctctaatgcccatatgtgggcattggttagccaggtcatccatcttgcaatttcttctgcatcttagtgtgtttgctttggcattatcatctcagttctttccttacaccatgtctgcacctaagaggattgtttttcagcatactttccatactgcaggctcaagtcagattttggaatccacttatgatttttctgtaactgactccaattctttacttttccttttcaaacattcacctgaagtggcaaaggaattgaatattacttcagagttttcatttgaatctgcatcattgtctaaacacaatgattggatggcaatttttccactttcttttctcttctcaaatagtctcaagttccctgcgaaaaaggatgatattttgaaacagtatgaattctttccgaaattgtctgttcaaaatccatctttaaattccaaaaagggacccagaagagttcacttggagctttatttaggttccttggaagaggtctgggttgcggtcctcaacatcactggtcctttatcaagttggtcatttgcagataatttgcttccaggaactgaaacctatggtgatggtccacaatcatatatatgtcgtcttagtggacctagcgatgggaattggaccttctggttagaggctaacaactctgaagcattacgagtggacctagcaattttagaccaaaagttggttgatccaataaagagattgaagaatctttttccagattgggttgatgttgttgcatattctagttttatgtctagctatatcttctaa

SEQ ID NO: 3393 - DNA, 1356 bp, Glycine Max
atggcgttgaatttctcgcatcgaccgattttttctgaggataatttggtttcgccgatgaggatggggattccagagaagagtgttgttgagaattgctttgattatgggagagataggagtggtggtggtgcgagccacgatgacattctcgatcttttgccgtcggatcccttcggcatggacatcagcaccaccgtcacggccatcaccgggtggctcgaggatttggagattgttgattatggtgggtaccgtagggatgagcttggggcgagtgatggcaattaccagctttttgctgggttgaatttcatttggaacaatgctatgagattccatgcctcatgtgttgaggagaagagagggtttggcgagagctgttctgtgagaaatgatggggctgctgctgcatcgaacaattttgggtttggatctgttaataattatgatgaagtgtcgggtttgcctgctactagcgggtctggtgatgttgtgagacggggtggaggaggaggcgggggtgatgagcttgctcctcacccggccttgagtttttctcttggttacctgggtttgtctgatctgcttgttgttgaaagggtgtgtaaatctttacattccacggttcgtggggatccgcttttgtggaggagtattcatgtggatcagcctttgaacgagaggattactgatgatgttcttttgcaattgaccaacagggctcaaggtcatctccagtgcttgagcctggtcgagtgtaccaggataacagatgatggtttgaagcggattcttgaaggcaatcccaagttaaccaagttgagtgttccaggatgtacaagactcagtattgagggtattgtgactattttaaaagcttacaactctatggatacccaaggggtgaagcatttacacataggtggtctttatggtgttacacaaaagcattttgaagagctgaggttcttgttgggggctgatagtccgctgctcccacactctcacaaatcacactattatcgcaggggaaacttgtacctgtcctgtgatgatgatcaagccatagatattgaagtttgtccacgatgccagaatttgaggcttgtatatgattgtccggcagagagttgtcaaggggtggagcacactactcaggtgtgcagggcatgcactctatgcatacccaggtgtagccagtgtggtcgctgcatcaatgacagtgaatatgaggaaacattttgtctggaattgctttgttcttcttgttctaagcagctagtcaaatgttcagaaaggggagataggaagattggatcagataaatccgttgttattcatgagcaaaactag

SEQ ID NO: 3394 - DNA, 818 bp, Glycine Max; identical to SEQ ID NO: 427

SEQ ID NO: 3395 - DNA, 483 bp, Glycine Max; identical to SEQ ID NO: 428

SEQ ID NO: 3396 - DNA, 690 bp, Glycine Max
atggctaatgctacacctaatggttcggtgccacacaaccacgtaggagcagtgcttccaacaattcccacaatcaaaattgatgagaagcaaaccctagccaccagcgaagaccacaccagcattgactatttacaaagggcacagtggcttcgtgcagccgttttaggagccaatgatgggttggtttcggtaacatcattgatgatgggtgtaggagctgttaaaaaagatgcaaaagctatgttagttgctggttttgcagggttagttgcaggggcttgtggcatggcaataggagagtttgttgctgtgtgcactcagtatgaagttgagctaggtcaaatgaagagagagatgaatatgagtgagggaggagagagagacttggagacggagaagagaacattgcctaatccattgcaagctacttgggcatctgcactctccttttctattggtgcattggtgcctctactttctgctgctttcgtagcagattacagaactagggttattgtggttgtggcaatggctagtttggctttggtggtgtttggaagtgtgggggctcagctgggaaaaactcctaagttaaaatcttgtgtaaggttccttcttggaggatggatagccatgtccatcacttttgggttaactaaattaatgggtgctagcgctttagaataa

SEQ ID NO: 3397 - DNA, 1590 bp, Glycine Max
atggctaattcaatggtaaacctagttttcctttctctcacccttttcatttcaattttccctgcaacttctacttttgctggccaccagaaaggtttccttcaatgttttcaaacaatgttaggagttgacaacacaacttcaggagtaatattcaccaaaactagttcttcttatgaacccattttggagtcttctataagaaacgccagattccttaacagttcagccccaaaaccaaaccttattgttacaccacatagcctattccacatccaagtagcactcttttgctcaaagaaaagtggcttacaagtaagaattcgaagtgggggccatgactatgagggcctttcttatgtctctcattctcacattccattcttgatcattgatcttgtcaaccttaggtctataaccattaacatggacgaagaaactgcatgggtacaatcaggtgctacagttggagaactctattatgcaattgcaaagaaaagtaaggtccatggtttcccagctggaagttgttccactattggtattggagggcacttgagtggaggtgggtttggtacaattttcagaaaatatggcttaggttctgataatgtaattgatgctcagattatagatgttaacgggaagatactgaacagaacactgatgggagaagatctcttttgggccataagaggaggaggagggtctagctttggagtcattactgcatggaaaatcaaacttgtacctgttccttcaaaagtcacaacttttgatgtttcaaggacccttgatcaaggtgccactacccttttccacaaatggcaaactatcgctcccaaacttccaaaagaacttttcttgcacactgttgtgggagttaccaattcagcttctcaagaaggtggaaaaactgtggtggtttccttctccggactgtatcttgggacacctgagaatctccttactttgatgcaaaacagttttgcagaattaggtttgcggcgcgacaacttcaccgagatgacttggattcaatccgttcttcactatgcaggcttttcaattgatgaatccttggagatcctgctcaggagaaaccattcacctccatctttcaaagcaaaatctgattatgtgaaggaaccgattccgttacgtggcttagaagggctgtggaagatgctactcttggataactcaccactgttgatcctcacaccatatggtggaataatgagtgagatttcagaatcagaaactccgtttccacacagaaaagggaacttatatggtatccagtatatggtgaattttgcttcaaatgaagatgcgccaaagcatatagattggataagaagattgtatgcatatatgacaccttatgtgtcaaagtttccaagacgagcatatttgaattatagagaccttgatttgggagccaaccaagggaaaccgtggtatgaaaaagcaaaatcttggggtttgaaatatttcaattgcaattttgaaaggctggcactagtgaaggccagggttgatcctggaaattttttcagggatgagcagagcattcctccattgtag

SEQ ID NO: 3398 - DNA, 774 bp, Glycine Max
atggctacattctttggttcccctccaattttctccctccccctcactagaactcaccacatttcttcatcatcacaaactccaccaccaactcctcctccacaatctcagcctccaacttcgtctccacagcagctaagaacaacaaatttgaatgatgaatcaatgcaagtgtgcactgaagctaagcaacagaagcccatcaaaccatccactaaggttgaatccacagattggatagccacttccttgaccagaaggtttgggataggagctggtcttgcatgggttggctttcttgcatttggtgtcatctcagaacaaatcaagactcgccttgaggtgtctcagcaagaggcaaatacaaggaacgttgagaaggtggaagaggtggtgcttcctaatggcataaggtactatgagttgaaagttggtggtggcgcatcgccaaggccaggagatttggttgtgattgacatcacgggaaaaattgaaagcagtggagaagtgtttgtgaacacatttgagggggacaagaaaccattggctctagtgatggggtcaaggccatatagtaaaggagtgtgtgaaggtatagaatatgtacttaaaactatgaaggctggaggcaagaggaaggtaatagtccctcctcaattggggtttggagagaatggtgctgactttgactcaggcactggtgtgcaaattcctccacttgctacacttgaatacattctagaggttgaaaaagtctccattgcacctgcttaa

SEQ ID NO: 3399 - DNA, 618 bp, Glycine Max
atggctaccactaaagtttacattgtttactattctacgtacggacatgttgagaagttagctgaagagattaaaaagggagctggttccgttgaaggtgtggaagcaaagctatggcaggtacctgaaacactttctgaagaggtccttgggaagatgggtgcacctccaaagagtgatgtaccgattattacacccaacgagctacctgaggctgatggcttattgcttggtttccccacaagatttggactgatggctgctcaattcaaagctttcatggatgcaactggaggcctgtggcgcacacaggcactagctggaaagcctgcaggaatcttttacagcactggttctcaaggaggtggacaagagactactccgttgacatctattactcagcttgttcaccatgggatgatttttgtgcccattggttacacatttggtgctgggatgtttgagatggagaatgtgaagggtggatccccttatggtgcaggtacctatgccggggatggttccagacaaccaactgagttagaattggctcaagcttttcatcaagggaagtactttgctggcattgctaagaagcttaagggatcatctcagtga

SEQ ID NO: 3400 - DNA, 321 bp, Glycine Max
atggctacctccagaggtcgaccacctaagagaaaatccccagatgataatgaggctactgataatatccaaatcaatttttctatcatagatcaggatgggcgccatatgtacttcaaggtgaatcacaacttggagttaattaaggtattcaaagatttctgtgagcgaaagaacttggaatacgagacaatgcagttcctatgcgatggtattcacattaagggaaaacatacaccaaaaatgcttaatatggaagatgatgctgagatctttgccgcgacacatcaagttggaggtggtggtgacatgagatgttag

SEQ ID NO: 3401 - DNA, 321 bp, Glycine Max; identical to SEQ ID NO: 3400

SEQ ID NO: 3402 - DNA, 321 bp, Glycine Max; identical to SEQ ID NO: 3400

SEQ ID NO: 3403 - DNA, 780 bp, Glycine Max; identical to SEQ ID NO: 429

SEQ ID NO: 3404 - DNA, 852 bp, Glycine Max; identical to SEQ ID NO: 430

SEQ ID NO: 3405 - DNA, 852 bp, Glycine Max; identical to SEQ ID NO: 430

SEQ ID NO: 3406 - DNA, 639 bp, Glycine Max; identical to SEQ ID NO: 432

SEQ ID NO: 3407 - DNA, 990 bp, Glycine Max; identical to SEQ ID NO: 433

SEQ ID NO: 3408 - DNA, 1320 bp, Glycine Max; identical to SEQ ID NO: 434

SEQ ID NO: 3409 - DNA, 233 bp, Glycine Max
atggctcaagtacaaagtggccaagctagtgaaggaattattaagctgtttgggacaacgattaggttgtatggtagagaaagaaaagaagataaaaaccatagagaagatgggacagatgaggacataaagagagctgataagatcattccatgcccaagatgcaagagcatggaaaccaagttttgctacttcaataactacaacgttaatcagcccaggcatttctgcaa

SEQ ID NO: 3410 - DNA, 495 bp, Glycine Max
atggctcagaaaaccgagaaagaagaaaccgacttcaaggttcccgaaacgattacgctttgcgttaacaactgcggcgtcaccggaaaccctgctacgaataacatgtgtcagaagtgcttcaccgccttcaccacctctaccgccaccacgtccggcgccggaggtgccggaatagcttctccggctaccagatccggcatctccgcgcgtccactgaagagatcttttcccgaggagccctcgccgccggcggatcctccgtcttcagaccagacgaccccgtcggaggcgaagcgcgtggtgaaccgctgctccggctgcaggaggaaggtcggactcaccggatttcggtgccgatgcggcgagctcttctgcgccgagcaccggtactccgaccgccacgactgcagctacgactacaaagccgccggaagagaagccatcgcgagggagaatccggtgattagagccgcgaagatcgtcaaagtctga

SEQ ID NO: 3411 - DNA, 501 bp, Glycine Max
atggctcagtatgctaaggagttttatcaacgaggagtgaagctcttaggtttatcttgtgatgatgtgcaatcccacaatgagtggatcaaagacattgaagcctacactccaggtgcgaaagtgaattatccaataattgctgatccgaagagagaaatcatcaagcaactcaacatggttgaccctgatgagaaagactccactggcaacctaccctcaagggctcttcatattgttggcccagatttgaagatcaagctgagttttctgtaccctgccactactgggaggaacatggatgaagtgctgagggtgatagagtcattgcagaaggcctcaaagttcaaggttgctaccccagcaaactggaagccaggggaccctgttgtcattacccctgatgtcaccaatgagcaagccaaggaaatgttccctcaagggttcgagagtgtgaaactcccatcaaagaaggaatatttgcgcttaactaaagtttga

SEQ ID NO: 3412 - DNA, 462 bp, Glycine Max
atggctccaatgagtctcccacctgggtttaggttccaccccactgatgaagagcttgttgcttactacttggagagaaaaataacaggtcgctccatagagcttgaaatcattgctgaagttgatttatacaagtgtgaaccatgggatttgccagataaatcatttctcccaagcaaggacatggagtggtacttttacagtcctagggacaggaagtacccaaatgggtcaagaactaaccgtgcaacacaagctggatactggaaagctacagggaaagataggccagtgcactctcaaaagaagcaagttggcatgaagaagacattggtgtactatagaggtagagcaccacatgggattagaaccaactgggttatgcatgaataccgtttaattgaatcagttcctgtcaagtcaagttcactagaccatacccattttctatgcttatacaga

SEQ ID NO: 3413 - DNA, 852 bp, Glycine Max
atggctcctagttctgctcacaacaatgggttctatgtgcttatgctagttgggatagtggttagcactatggttgctacctgtgctggtagcttctaccaagactttgatctaacatggggtggtgaccgtgctaagatattcaatggtggccagcttctatcactttccctagacaaagtctctggctctggcttcaaatcaaagaaagaatacctatttgggaggattgatatgcagctcaagctcgttgccggcaactctgctggcactgtcactgcttactacttgtcatcccaagggccaacacatgatgagattgatttcgagtttttgggaaacctaagtggggacccttatattctccacacaaacatcttcacccaaggcaaaggcaacagggagcaacagttctatctctggttcgaccccaccagaaacttccacacttactctatcatttggaagccccagcacatcatattcttggttgataacacacccataagggtattcaagaatgctgaacctcttggtgttccttttccaaagaaccagcccatgagaatctattctagcctctggaatgctgatgactgggccaccagaggaggattggtgaaaactgattggtccaaagcaccctttacagcatactaccgcaatttcaaggccattgagttctcatccaagtcttccatttcaaattctggggctgaatatgaggcaaatgagcttgatgcttatagcagaagaagactgagatgggttcagaagtacttcatgatctataactactgcagtgatctcaagcgattcccacaaggtcttcctgctgaatgtaaacgttga

SEQ ID NO: 3414 - DNA, 1029 bp, Glycine Max
atggctccttttgcttttgcaacattgccctcttctcacatctgccgcctcccaaagcccacaaacttgaagtttcgagttcgctgctctactgccgcgtcttctccttcttcggtttccactagatcaaaagctgctggctttgatttgaagacatactgggccaacctaatggtgcagatcaatcagaagctggacgaagctatcccggttcagtttcctccgcagatatatgaagctatgaggtattcagtccttgccaaaggtgccaagcgagccccacctgttatgtgcatctctgcctgtgaactctttggtggcagccgccttgccgcctttcccactgcctgtgcccttgaaatggttcatgcagcttcattgatacacgatgatcttccctgcatggatgactccccctcacgccgtggtcagccttcaaaccataccatctatggtgttgacatggcaattcttgcgggcgatgcactctttccccttggatttcgacacattgtttcacaaactccatcagaccttgtgcctgagtcgcacctccttcgtgtgattgccgagatagcccgctctgtaggatccactggaatggctgcagggcagttcctggaccttgaaggaggacccaatgcagttggatttatacaagaaaaaaagtttggtgaaatgggggagtcttctgcagtgtgtggaggattcttggctggagctgaagatgatgagatagagagactgaggaggtatgggagagctgttggggtattgtatgcagttgtggatgatattatagaagagagattgaaagttgagggagatggtgacaggaaaaacaagggtaagagttatgcagaggtttatggagttgaaaaggcaatagaaaaagctgaagagctcagagcaaaggctaaagaagaattggatggatttgagaagcatggggaacgggtctttcctctctacagttttgtggattatgcttttgatagaagtttcagtgttgatgatgccagtggataa

SEQ ID NO: 3415 - DNA, 1029 bp, Glycine Max; identical to SEQ ID NO: 3414

SEQ ID NO: 3416 - DNA, 396 bp, Glycine Max
atggctcgtatgaagcaaaccgcaaggaagtccactagaggaaaagctttgagaaagcaacttgccacgaaagcaacacacaagtccgctccgccgaccggcggcgtgaagaagccgcaccatttcaggccaagtacggtggcgctaagggagatccaaaagtaccagaagaacaccgagcttctcataaggaagcttcctttccaaagactcgtaagggaaatcgctcaggacttcaagaccaatctctacttccacagcagcgccgtctccactctccaagaagccgcagaggcctacctcgttgtgctcttcgaggacaccaacctctgcaccattcacccaagagagttgccattatgcccaaggactgaggcctaccttgaaaggaattaa

SEQ ID NO: 3417 - DNA, 618 bp, Glycine Max
atggctctcaccttcactctagccttggcagctgatcacagtccacttcaggatttctgtgtggcagaccccaaaagtcaagtgctagtaaatggattggcttgcaaggaccctacactagtaaaggccaatgacttcttcttcagaggacttcacctagaaggaaacacatcaaacccagtaggatccaaggtggctccagttacagtttcacagctaccaggactaaacactttaggaatttcacttgcccgcattgactttgcaccgtggggcacaaaccctcctcacactcaccctcgtgccaccgaaatcctcaccgtgatcgaaggcactcttgaagttggtttcgtgacatcaaaccccggaaaccgccatgtcaccaaagtgctgcaaaagggtgatgtgtttgtcttccctgtgggacttgtgcactaccagagaaatgtgggttatggcaatgctgttgccattgcagctctcagcagccaaaacccgggggttatcactattgctaatgctgtgttcggggccacgccagacattgctagtgatgttcttgccaaggcttttcaagtggacaaagatgttgttgctgatttaaagtccaagttctag

SEQ ID NO: 3418 - DNA, 1092 bp, Glycine Max; identical to SEQ ID NO: 435

SEQ ID NO: 3419 - DNA, 366 bp, Glycine Max; identical to SEQ ID NO: 436

SEQ ID NO: 3420 - DNA, 495 bp, Glycine Max
atggctgaaactccatcaccctctgagtctcccacagcctcctttggccccatcataagtaatggccaagttggtggcttcgattggattgtccttgtggcagcaattttatgtgcctttgtgtgtgctcttggcctcaacacaatgttacaatgtgtgtttcaatgtgcttgtcgtgtcctcacagagcctcgccaatggattgcttcacgaaggctcaactctggcctcaagaaaaaggaaatggtggctttgccaacctcaacttacactactacacactctgctgctgcctcttcttcttcttcacctaattctagtagttgtgtcatttgcttggctgagttctctgatggggaccctataaggttccttccaaagtgcaaccactatttccatgtggtttgcattgacaagtggctactctctcactcttcttgccctacttgcaggcacctcctcaaattaaatactccagcttgttgtcgacggtga

SEQ ID NO: 3421 - DNA, 3381 bp, Glycine Max; identical to SEQ ID NO: 437

SEQ ID NO: 3422 - DNA, 2211 bp, Glycine Max
atggctgatagtagtgggtctatgggggcaagttgtcccactgcaccaataaggggacaacgaactccaccggaatctgaatcacctgctgactccaacactcaatcttcatccgaaggttcgcaggaggtgcgtagcaaaattaaacgtagtcatgagcttgtggatcaattcaaccaagaaaaatttaattctgcgattacaaggatgattatcgttgatatgcttccatttgaatttgttgaaaatcccggatttagagaatttagtgctctgctagcagctccagtggaatcatttggagaattttttagcgctcttctgacaattccaacggaatcacctgttgtggcatctttgcaagagttaggtaacaatttgacttatgatgagcttgtggaattccaccaagagttttgtacacaagcgcttgcgaagatgattatcattgatgaacttccttttaaatttgttgaaaataaaggatttggagaatttgttactgcttttcaacctcaatttaaaattcccagtcagataaccattgttgaagattgcatgaatttgcacagggtggcaaaagcgaaattgaaattcaatttgtctcaaaacaaacaaatgatgtcattgactactgatacttggacttcaatccataataagaattatctgtgtgtgactgcccactgtattgatgaacggtgggaattaatcaagatgattttgagttttgtattgattcctgaccataagggagacaccataggtaaagctttagagaaatgcttgaaagagtgggaaattaccaaaatttgtactattacagtacataatgctgatactgagaatttggcttcatcgtatttaattcaaaatatgtgtggttggaatggcactaccttactgaatggggagcatgtgcacttgaggtgttgtacccatatattgaactcaattgtgtctgatggattacaagaaatggattgttgcattgcaagaataagggctgcatgtaagtatgttaggtcattttcatctagatatgcgtgttttaagaggtgtgccaatttggcaaatataaactgtgatcaaatgattgtgcttgatgagccaacaaagtggaattccacctatttaatgttggtggttgctgaaaagtttgaaaaggcctttaacctccttgaatttgaggatgattcttatgtgaaatctcttgataatgaagggggacctccaagtgctgatgattggaatcgtgcacgtgtatttattaaggttttaaaggttttttatgaggctacactttctttctctggttatttgaatgtaagttctaactctttcttgcggatgtgggtcaagattcaaaatgcgttgagatcatggatggagaatgatgattttgggctgcaacagatggcaactactatgaaattgaaatttgacaagtattgggatattgatgggaatattaataatctgttgtttgtggctatttttcttgatccacgattcaagtttaaatatcttgaattctgttttgggagaatgtatggtcctgaaaaatgcaaggacatgcttaaaaagttggaagatttcataaaagaattgttcacacagtatagttcatcgcatcctattattcctgatatttgtgagtctagtggcctatcctttgatgttacctcccaaacaattgtgagtaatgatgatggtggtaatatggatatggatgaggagtatggaataacagtgaagaaaatgctagatgaacttgagaaaaatgagctagagagatacatgaaggatcatgtagaggttaattatgatggatttgacattttgagatggtggaaaggcaagtccactaagtattatgttcttgcacacatggctagggatatattagccattccagtgtctagcgtgtcttttgaggatgcatttagcacaggggatcatgtccttgatcgataccatagttgtttggatcctaccacagtcgaggctttgatctgttcaaaaagctggttgagccacaacttaagaaagaactgggattcacatcaaacatttgatgtggtgcaagctgaaagagatatgttagaagattcagaccttgaggagtatgatgctaccacacttgaggctttggtctgtttaaatagctggttgagtgacgacataggaaagaatggggattcacattaa

SEQ ID NO: 3423 - DNA, 657 bp, Glycine Max
atggctgatgcatttgatgaagagtgtgattatctcttcaaagctgttttgatcggagactccggagttgggaaatcaaatctgctctcaaggtttgcaaaagatgaattccggttggattccaaacccaccattggagttgaatttgcttaccggaacatcaaggttggagacaaactcatcaaagctcaaatatgggacactgctggccaagaaaggtttagagcaatcacaagttcatactatagaggagccttaggggcaatgctagtgtatgacataagcaggagatcaagttatgagaatgtgagcaaatggctactggagctgagggagtttggaggcgaggacatggtggttgttctggtgggaaacaaatgtgatctggatggtcaatcaagagaagttgacaaagaagaaggaaaagggtttgcggaaacagaaggattatgcttcatggaaacctctgctttgaagaatctcaacgttgaggaagttttcttacaaatgatcacaaggatttatgacatgacaagccagaaaaatttggcagctaaaatggacgagaaaccgattaatcttttgaatgggaaggagatccatatagctgatgaagtcactgcaactaaacaatctagtacttgctgttcaagatga

SEQ ID NO: 3424 - DNA, 582 bp, Glycine Max; identical to SEQ ID NO: 438

SEQ ID NO: 3425 - DNA, 816 bp, Glycine Max; identical to SEQ ID NO: 439

SEQ ID NO: 3426 - DNA, 618 bp, Glycine Max; identical to SEQ ID NO: 440

SEQ ID NO: 3427 - DNA, 387 bp, Glycine Max
atggctgattgtgatgatgaacacgttaatcgaattggcgacttaccgatgaatgtgattgttagcatcctacaacgcctgcccttccaagacttagtgaagaccagtgtactggcaagggcatggaggtatatgtggtcgtcgaccccacggcgtgaatttagagatgacttttttgagaagtgtaaccatcttggataccttgaaacttccgccattattacggaagctcttcttctccacaccggccccatacacgtctttgctgtcatccctcctccgcactatcctatcaaattagaatgcctcaacaagtggattctgtttttgtcgaggaaaggggttaaatatattgggcttgcgagtgaacaagaagatccctattga

SEQ ID NO: 3428 - DNA, 1080 bp, Glycine Max
atggctgattgtgatgatgaacacgttaatcgaattggcgacttaccgatgaatgtgattgttagcatcctacaacgcctgcccttccaagacttagtgaagaccagtgtactggcaagggcatggaggtatatgtggtcgtcgaccccacggcgtgaatttagagatgacttttttgagaagtgtaaccatcttggataccttgaaacttccgccattattacggaagctcttcttctccacaccggccccatacacgtctttgctgtcatccctcctccgcactatcctatcaaattagaatgcctcaacaagtggattctgtttttgtcgaggaaaggggttaaatatattgggcttgcgagtgcacttgagagtcttatatctggttgtcccttacttacgaacctccagctttcttactgttctggttttgaacatattgatgtctctgctccttttctccaattcctaatgatagaaggtgatgaggttatcaagtcaatttgtttgaaggaaccacatgatttgattcttatccaactctttgctgatggtcctggggataacattgatagagcttgggtagctgatctgttggaagactcgccgaatgttgagaggttatttttgggaacaagttacattaagattttgtctgcaggcttctatccgcaagtggagcttagagctataaaatatctggaatggatgtgcaatagcatggcagtggagctacaacagattttggatgtgtttgactatagtaactgttactttaatctgcttcaagatgtgaaaatcacagttaaaacttcctataagcctgcacttgatttgatacggcttgtgcttgcaagatcaccggcattgaagatccttactttcagggccatggaccttcgcaacaaggttggcggtgacaaaggacgtgtgcggcatgagggggagagggagggtgatggccatgaaggaggtggcggtgctgcgacatgtaaaaggttggagcaaagggcgatggtagtgttgtggcgtggcggaggtggcgtagcggagttgatgaggaggtgcgaaaagtaa

SEQ ID NO: 3429 - DNA, 429 bp, Glycine Max
atggctgcatccggggatcccctattggttggtcgcgtgataggtgatgtggtagatatgttcattccttccttcaacatgttcgtttactttggccccagtgaaccaagtatgcgtgagtggatacattggatcgtagttgacatacttgaggaacaaacccatttcgtgtttcatgatgttgcatgcatgagtactggtgggtccagaaaagagattgttccatacctgggaccaaggccacctattggaatacatcgttacatatttctattgtttcaacagaaagtgcctttgggtcttgtggagcagccaccaactcgcgcaagtttcaatactcgctattttgtccgacaattggacttgggccttccagtggccaccgtctacttcaactctcagaaagagcccgctgccaagaggcgttga

SEQ ID NO: 3430 - DNA, 2763 bp, Glycine Max
atggctgccaacaagtttgcaaccatgttacatagaaacaccaacaaaatcacccttgttctagtctatgccatcctagaatggattctgatcatcctcctcctcctcaattctctcttctcttatctaatcataaagtttgccgattactttggcctcaaaaggccttgcatatggtgcaccagaatcgatcacatcttagagcctgggaagtacaagagttcttgcaaagatcttgtgtgtgaagctcatgcctctgagatttcaaaacttggattctgctccaatcaccacaaactggctgagtcacaagacatgtattatgtcaaactctcccagagttttggtttctttccatggatgaagcagataggtatgattcagggtgagggtgcggatgctggtgacaaggcaattgtgaaggtggaagaggctttgaggtgttcttgctgtggtgtcaacttgtacaacagattctaccctccttgcattttgatcaagccttctctcaatgttttggagtatgaccagaagcagaattcggtgacggagcgcggcgttggtttggagattgatgaagatcacaccggatctgatattgtgcttgatcatcatcatgatgaaaaggagagtgaagaaaacaagggaagccacatggtgtttgaggttgatcagggtttggatagaaaagatgaggaggcagagaagagttgtgattgttctgtttggatttgggaaagtttgaatgtccctaatcctaaggttgatgatggtgatgatgatgttgttgttgctgatgatgatgatcaagcttgtgagaaatccagtgctcaagttgattgcactagagagataactgtggagactccacccatacatcttgaatttttcattcatggtgatgattgcagattgattcctattgaattggttgactcccctgccccagaaaacaggaatcaaagcagatataagttgggaggtgaagacctcaacagcaatgaagattttattctggactttgataagagtgctgatgcagaagctgaaccgaatttccaacacaagggaatgaaaatgtttccaagtccaatggggaattgtgaagatgtgagatttgttcaaaccgctgatgacttgaccaatgatgataatgttgaagccaacatggaaagaagagttgcagaactatgttcagatgtttctctagcatctgaagatgcatcacaaatgcaaggtgaggaatatgaagcagaagtctcaatagggactgaaattcctgatcaggagcaaatggatgagtatgaaagccaagatgttcttttgtatacaaaccaacaaatacaagaagatgcatctactagcgcagtcagatttaatgtgcaagatgaaattggtgatgacaaaggtgaagattttgtagaatttaaaaccatgtcacttgaagtgaaaatgccaacagtaaataaccatttgccatctttattggagcttaatgagaatgaggaagaaaaggttccttacacacccacttctttggagagtctacatcagctacacaagaaactacttctccttgagaggaaagaatcaggaacagaagagtcattggatggaagtgtgataagtgatatagaaggtggtgaggtaacaattgataagttaaaatcagcattgaaatctgaaaggaaagccttaagtactctatatgcagaacttgaagaagagagaagtgcatctgctatagcagccaatcaaacaatggcaatgataaataggcttcaagaagagaaagcagcaatgcagatggaagccttgcagtatcaaagaatgatggaagaacaatctgagtatgatcaggaggctttgcaactcttgaatgagctcatgatgaagagggagaaagagaagctagagctagaaaaggagcttgaagtatatagaaagaaggttcatgaatatgaggtaagagaaaagatgatgatgtcaagaagagatggtagcatgagaagcagaacttcatctccctcttgtagcaatgctgaagatagtgatggattgtccattgacttgaatcacggagcaaaggaggaaaacgggttttatagtcatcaagatcaagaatgcagcaaccagaacacccccgtggacgcggtcttatatttagaggaatcattggcgaactttgaggaagagaggttacaaattctagaacagctcaaggtattggaagaaaagctagttatattgaattatgaggaagatcgctgctctgacgatgctaaattagtagaacatctttgtgaagagaatggaaatggataccatcatgatcatgatgatcacaatggtcaagtaaatggattttcaaatggtcatgcaaagaaaataaatggaaagcatcaagggaggaaactcatgggtgcaaaaggaaagaggcttcttcctctttttgatgcaatgagttcagaagcagaagatgtagagttgagtggagacgagttagatttccctcacttgcaaaacaattcagttgaaaaggttaatccggataagaaaaatattgctttagaggatgaggtcgataatttttacgagagactacaggtgctggaggcagatagagagtttctaaagcattgcatcagctcattgagaaaaggggataaagggttacatcttctccaagaaattttacaacatcttcgcgaactgaggagtgtagaactcagggtcaagaacatgggagatcttgcagtataa

SEQ ID NO: 3431 - DNA, 1404 bp, Glycine Max
atggctgccacgagaccggtgcagtgtttgttacgaagggtttgcagaggaagtaggactattggggttgccacagaagttaatgcttcttcttcttctcagaaaatcatcgacaaggaatatgaacacagtgctcacaattaccatcctcttccgattgtatttgctcaagcaaagggaacctctgtttgggatccagagggaaacaaatatcttgattttctatcaggttactctgctgttaatcagggacactgccatcctaaaattctgaaagcattgcaagaacaggcagaaaggttgactgtgagctctcgagccttctacaatgatcgcttcccagactttgctgagtatgtgacaaacatgtttggttatgatatggtacttcctatgaataccggtgctgaaggtgtggaaacagcactgaagttagcacgaaagtggggttacgaaaagaaaagaattcccaaagatgaggctattattgtctcatgttgtggctgcttccatggtcgtacactaggtgtcatatctttgagctgtgacaatgaagctacccgtggttttggtcctttattacctggcaatcttaaagttgattttggtgatgcagaagcccttgaacaaatttttaaagaaaaaggagagcacatagctgcatttattttagaacctgtccaaggtgaagctggggtgatatttcctccagatggttatttaaaagctgttagagatctttgctccaaatataatgtcttgatgattgctgatgaaattcaaactgggttagcaagaacggggaagatgctggcttgtgagtgggaagaagttcgcccagatgttctgatactagggaaagcattgggtggaggagttataccagttagtgcagttcttgcagacaaagatgtgatgctttgtatacaacctggacagcatggaagtacctttggtggaaatccaatggccagtgcagttgcaattgcctctctagaagtaataaaaaatgagagactcgttgagagatctgcccaaatgggagaggagcttactggtcagctgcttaagattcagcagcaatacccagactatgtgaaggaggtacggggaagaggattgttcattggagtggagtttaacagcaaaaaattgttcccagtatcaggctatgagctatgcaaaaaattgaagtatagaggagtccttgccaagccaacacatgatgcaattatccgctttactcccccactttgcataagtgtggatgagatccaacaaggttccaaggcactggctgatgttctggaaattgatctaccaaagttgcagaagacaaagccaatagatgctgctccagttgccactagtgcatgcgatcgttgtggtagagtcttgtattaa

SEQ ID NO: 3432 - DNA, 1740 bp, Glycine Max
atggctgctcaattgcaaaaatctgcagatgaaatgaggaagaagcttcatggtgattcttcaacggttgaactcaataattccaattcggttccttccaagggtgcaagttccccttctgatgcaagatcatgtgtatcatccataggggatgcttctggtagtgttaaggaagttgatgtggatcatgagtacttgtccacagatcagggcgttccttatcctgccggcggctattacggttactactatccaggttatggtggtttctatggagagtcagacaaccaagggtactatgttggtgccgatgccgtggatcttcagtaccctgtcatgcaagcagataatggttcttatgtctatctcgtgccaggatttcagactggctacccttcatactatcatcctctaagtccagctggtattgaaggacagtatgttggccataacgtctacccccctggctccatctatcaacaaccgattggatcgcctggttattatccagcttctctatcatatggagagttacagccaacaacatactcgtgggattcacctctaatcaatcaagatgggttacaaggacatggttataatgaactggctggtaaaccaaatggtagatccaatttgtcttcccagagtcatactagtggtgttgtgtcaaagtctgcacccccacctaactcggcagaagggaagggtttgacatcattattagaggtctcatcaactcatgttaagcataaccagccaaaacaaacaaacaaggcaccagtttcggtcctccattcacctgttgcaaagtttcccgcatacaatcaaggaaagagcggattcctctatccaaacaacttgcttaatgtgaaagcaaacacaaagggctgggttagtactgaaaagttgaaacagagaaacaaggtcaacgattcactcaatgagcagaatcaaggtcctagaacagctaatgcaaaaggtgcattaatgtctggaggtaattctgtgagaggctcagccccaggtgggagtggaaatgttaccaacaaaatcaggacagatcagtacaaccttcctgattttccaaccaaatatgatcatgcacttttctttgtcatcaaatcttacagtgaagatgatatccacaagagcatcaagtacaacgtgtgggcgagtactcctaatgggaataagaggctggatggtgcatttcaggatgcacagaagagaatggaagagaaaggatgcaagtgccctgtgttccttttcttttcggtcaatgctagtggtcaattttgcggagtagctgagatgactggacgagttgatttcaacaaaagtatggatttctggcaacaggataagtggaatggatatttctctgtcaaatggcacattataaaggatgttccaaatcctcaactacgccacataatactcgagaataatgatcacaagcctgtcacaaatagtagagacacacaagaggtgagttttccccaaggtgttgaaatgcttaacattttcaagaattatgtggcaagaacttccatattggatgactttgaattttacgaaagccgccagaaggtattgcaggagaagaaaacaaggcaatctatgccccataccagtgtacagcaaatagaggaattaaccactacacttgggtcagtagacctatcatctgtgaagaacatggaggatcctaaggtggttgagagagtgaatgactga

SEQ ID NO: 3433 - DNA, 1698 bp, Glycine Max
atggctgctcaattgcaaaaatctgcagatgaaatgaggaagaagcttcatggtgattcttcaacggttgaactcaataattccaattcggttccttccaagggtgcaagttccccttctgatgcaagatcatgtgtatcatccataggggatgcttctggtagtgttaaggaagttgatgtggatcatgagtacttgtccacagatcagggcgttccttatcctgccggcggctattacggttactactatccaggttatggtggtttctatggagagtcagacaaccaagggtactatgttggtgccgatgccgtggatcttcagtaccctgtcatgcaagcagataatggttcttatgtctatctcgtgccaggatttcagactggctacccttcatactatcatcctctaagtccagctggtattgaaggacagtatgttggccataacgtctacccccctggctccatctatcaacaaccgattggatcgcctggttattatccagcttctctatcatatggagagttacagccaacaacatactcgtgggattcacctctaatcaatcaagatgggttacaaggacatggttataatgaactggctggtaaaccaaatggtagatccaatttgtcttcccagagtcatactagtggtgttgtgtcaaagtctgcacccccacctaactcggcagaagggaagggtttgacatcattattagaggtctcatcaactcatgttaagcataaccagccaaaacaaacaaacaaggcaccagtttcggtcctccattcacctgttgcaaagtttcccgcatacaatcaaggaaagagcggattcctctatccaaacaacttgcttaatgtgaaagcaaacacaaagggctgggttagtactgaaaagttgaaacagagaaacaaggtcaacgattcactcaatgagcagaatcaaggtcctagaacagctaatgcaaaaggtgcattaatgtctggaggtaattctgtgagaggctcagccccaggtgggagtggaaatgttaccaacaaaatcaggacagatcagtacaaccttcctgattttccaaccaaatatgatcatgcacttttctttgtcatcaaatcttacagtgaagatgatatccacaagagcatcaagtacaacgtgtgggcgagtactcctaatgggaataagaggctggatggtgcatttcaggatgcacagaagagaatggaagagaaaggatgcaagtgccctgtgttccttttcttttcggtcaatgctagtggtcaattttgcggagtagctgagatgactggacgagttgatttcaacaaaagtatggatttctggcaacaggataagtggaatggatatttctctgtcaaatggcacattataaaggatgttccaaatcctcaactacgccacataatactcgagaataatgatcacaagcctgtcacaaatagtagagacacacaagaggtgagttttccccaaggtgttgaaatgcttaacattttcaagaattatgtggcaagaacttccatattggatgactttgaattttacgaaagccgccagaaggtattgcaggagaagaaaacaaggcaatctatgccccataccagtgtacaggtctgctttacactgcaaccttattccaagattactaaatatagttctcattga

SEQ ID NO: 3434 - DNA, 4272 bp, Glycine Max; identical to SEQ ID NO: 441

SEQ ID NO: 3435 - DNA, 1527 bp, Glycine Max
atggctggccccaaccccatccccaagtggttgtttctctctctgactctgatcctcagtctctctgtctccgtcggcgcccgccacttcgtcctcgtcctctcccaggaagactacaaggacgacccccccgccgatcccgactccgccgccgagtgggacgagttcggcgacggagactcccacaaatccgaggacgacctcgaccccggctcatggcgccccatcttcgagccccccgccggagatccccaacccctccccgaatccgacgccgcctaccactccgccgtccacaagctcatgtccggcgaccccgacctgatccaggacggcgccgccgagatcggcgccttggccgagaccgggcaccccgcgtctcaatcggtgctagggtttttgtggggaatggggcttttgagggagcgaagcaaggggaaggcctttctgtaccaccactttgccgcggagggtggcaacatgcaatcgaagatggcattggcatacagctacacgaggcaggacatgttcgacaaaggtgtaaatctgtatggcgaattagccgaagtggccgtgaacagctttctgatatcgaaggagtctcctgtgattgaggcggttaggcttcacaacggggcagaggagaacaaggaggctcttagaaaatccaagggtgaagaggacgaggactttcagatacttgagtaccaggcccagaaagggaatgctgctgccatgtacaaagttggtctcttttactactttggcctcaggggtttgaggcgtgaccattccaaggccctctggtggttcctcaaggccgtggacaagggagagcctcgatccatggagcttcttggagagatctatgcgagaggagcaggtgtggagagaaactacaccaaggccttcgagtggctcacccttgcttccaggcaccacctctattctgcctacaatgggatggggtatttgtacgtcaaaggctatggagttgaccagaagaactacaccaaggccaaagagtattttgagaaggctgctgataatgacgaggttggcggccactataaccttggcgtcatgtatctcaaggggattggagtcaatagggatgttaagctcgcctgtaagttctttgttttcgccgctaaccatggccaaccaaaggccttctaccagctcgctaagattttccatactggtcttggcttcaagaagaatattcctttggcaactgcactttacaaactagttgcagagcggggtccatggagttctttgtctagatgggctctagaatcatacttaaaaggtgatgttggcaaggcatttatgttgtattcaagaatggctgagatgggctatgaagtggcacaaagtaacgctgcttggattcttgacaaatatggggaacgcagcatgtgcatgggtgaatctggattttgcactgatgcagaaaggcatcagcgggcacattctctgtggtggcaagcttctgagcaggggtactgccagggattatga

SEQ ID NO: 3436 - DNA, 2016 bp, Glycine Max
atggctggccccaaccccatccccaagtggttgtttctctctctgactctgatcctcagtctctctgtctccgtcggcgcccgccacttcgtcctcgtcctctcccaggaagactacaaggacgacccccccgccgatcccgactccgccgccgagtgggacgagttcggcgacggagactcccacaaatccgaggacgacctcgaccccggctcatggcgccccatcttcgagccccccgccggagatccccaacccctccccgaatccgacgccgcctaccactccgccgtccacaagctcatgtccggcgaccccgacctgatccaggacggcgccgccgagatcggcgccttggccgagaccgggcaccccgcgtctcaatcggtgctagggtttttgtggggaatggggcttttgagggagcgaagcaaggggaaggcctttctgtaccaccactttgccgcggagggtggcaacatgcaatcgaagatggcattggcatacagctacacgaggcaggacatgttcgacaaaggtgtaaatctgtatggcgaattagccgaagtggccgtgaacagctttctgatatcgaaggagtctcctgtgattgaggcggttaggcttcacaacggggcagaggagaacaaggaggctcttagaaaatccaagggtgaagaggacgaggactttcagatacttgagtaccaggcccagaaagggaatgctgctgccatgtacaaagttggtctcttttactactttggcctcaggggtttgaggcgtgaccattccaaggccctctggtggttcctcaaggccgtggacaagggagagcctcgatccatggagcttcttggagagatctatgcgagaggagcaggtgtggagagaaactacaccaaggccttcgagtggctcacccttgcttccaggcaccacctctattctgcctacaatgggatggggtatttgtacgtcaaaggctatggagttgaccagaagaactacaccaaggccaaagagtattttgagaaggctgctgataatgacgaggttggcggccactataaccttggcgtcatgtatctcaaggggattggagtcaatagggatgttaagctcgcctgtaagttctttgttttcgccgctaaccatggccaaccaaaggccttctaccagctcgctaagattttccatactggtcttggcttcaagaagaatattcctttggcaactgcactttacaaactagttgcagagcggggtccatggagttctttgtctagatgggctctagaatcatacttaaaaggtgatgttggcaaggcatttatgttgtattcaagaatggctgagatgggctatgaagtggcacaaagtaacgctgcttggattcttgacaaatatggggaacgcagcatgtgcatgggtgaatctggattttgcactgatgcagaaaggcatcagcgggcacattctctgtggtggcaagcttctgagcagggtaatgaacatgctgctttactcattggagatgcatattactatggtcggggtactgccagggattatgagcgagctgctgaggcttatatgcatgctaaatcacaattgaacgcgcaagccatgttcaatcttggatacatgcatgagcatggccaaggacttccatatgaccttcatctggccaagcgttactatgatgaagctctagagcatgattctgcagccaagttgccggtcacgctggctctttcaagcctgtgggttcgtaagaactatgctgacagtttcatggtacaggtaattgattcattgcctgaactgtatcctaaattagaagcttgggtggagaatgtgcttttggaggagggaaatgctacaattctgaccctctttgtatgcctcttaactgtgctgtatctacgtgagaggcaacgaaggcaagctgccgttgcagctggagaggtggctcagccaaatcgcccaaatgagcttggtgcacccatgtag

SEQ ID NO: 3437 - DNA, 342 bp, Glycine Max
atggctggtgatacagcatcttccttctccacttgcatggccattttcttctctttgctcctactttctcacttcactatggccatgctagaacacaataacttttctccttcaacatctaacaaagagggtgccaagaagaggaacaccaaagtagttgcttcagcaagagaagaaagtgaacaaaattccaagaaggatatggcactaggagacactggcaaaggcagcattcatgttccaaagagagagcactctcaacactctcaatctcaaaacaggatcttcaatgctagtgcacatgaagtcccaagtggtccaaaccccatttcaaacaggtaa

SEQ ID NO: 3438 - DNA, 1323 bp, Glycine Max; identical to SEQ ID NO: 442

SEQ ID NO: 3439 - DNA, 615 bp, Glycine Max
atggcttatgttccacatggaaatgcaaatttcaactctttattcctaaaatttgcaatttctcatgtgggtatttcttctttgcccttcttgcacccgggactgaaatcttgtacagtcttcaacagaggaacactcattcgccagtgtttaaatggaaagcggaatttttctctatcagaaaagcgatttaattgcaagttttcaaagaaagacagattctttatccctagaagtagtagttcttctaactctagtggaagtacggatgaaccctctaatgagacagagaagacaccatttggatatacaaggaaagatgtcctattaattggacttggagttactttacttggcattggcttaaaaagtggactggagtttgttggagttgactcactgcaagcaggaaatgtagttcagctagtgctggttttgggccttacagttgggtggatctcaacatatatcttcagagtttcaaacaaggaaatgacatatgcacagcaactacgtgattatgaaagcaaagtgatggagaagcggttagagtccttaacagaagcagagctacaagcactgcttgaagaagttgaggaagagaagagtcgctag

SEQ ID NO: 3440 - DNA, 1092 bp, Glycine Max
atggcttcaaccgcttctgaggttagccaacaagtccaatccaacaacaacagaccaattttcaaaagcgtgaaagcactaactgaatcaccagaactcacttccctcccaccctcttacacctacaccaccaactcagatgatgaaatagtggcagacccagatgaagatgatccaattcctattattgactattccctcttggtcactggaacacctgatcagagggccatgaccatccacgacttgggcaaggcttgtgaggagtgggggttcttcatgctcatcaaccactttgtgtcaaagaccatcatggagaagatggttgatgaggtttttgctttcttcaatcttagagaggaggagaagcaagagtatgctggtaaggatgtgatggaccctgtgaggtatggcaccagctccaatgtttctatggacaaagtcttgttctggagggattttcttaaaattgtggtgcatccagaatttcactcacctgacaaaccacctgggttcagagagacatcagcagagtactgtagaagaacctggaaagtgggaaaggaactactaaaaggaatatcagaaagcttgggattggaagccaattacatagaggatacaatgaacctagattctggttggcaaatgatagcagcaaatatgtatccaccttgtccacaacctgagcttgcaatgggaatacccccacattctgatcatggcctcttgaaccttctcctgcagaatggggttagtggtcttcaagtgcttcacaatggcaagtggatcaatgtcggttccacttcaaactgccagctagtctttgtgtctgatcaccttgaggttgtgagcaatggcaagtacaagagtgtattacatcgagcagttgtgagcaacaaagctacaagaatgtccttagctgtagtaattgcaccatccttggacacagtggtggaaccagctaaagagtttctagacaatcaaaggaatccagcagcgtatgttgggatgaaacatagagactatatgcaactgcaaaaaagtaaccggcttaatggaaagtctgtgctagacagagttaaaatctga

SEQ ID NO: 3441 - DNA, 2571 bp, Glycine Max
atggcttcaagattctggacccagggtggaagtgattccgaggaggaggagagtgattatgatgaggaggttgataccacagtgggtgaagcttctggtcaagcagtgacaagcaggtacctgcaggataatgcaagtgacagtgatgactctgatggccaaaagcgcgttgtgaggtctgcaaaagataagcgttttgaggagatggcttccactgtcgaccagatgaagaatgccatgaagatcaatgattgggtgagcttgcaagagagttttgacaagattaacaaacagcttgagaaggtcatgcgtgtcactgagtctgaaagggtccccaatctttacatcaaggctctcgtgatgttggaagatttcttggctcaggctttggctaataaggatgccaagaagaaaatgagcagtagcaatgctaaagccttgaactcaatgaagcagaagctgaagaagaataataagcagtatgaggacttgattaataagtgcagggagaaccctgagagcgaggaggaaaaagaagaagaggagagcgatgaagaacagttcatgaaaaaccctagtgagatcacgtgggatgcggttaacaagaagtttaaagaggttgtggctgccaggggaagaaagggaactggtaggtttgaacaggttgagcagctcaccttcttaacaaaagttgctaagacacctgcacagaagctggaaattctgttcagtgtggtttctgctcagtttgatgttaatccgggcctcaatgggcatatgcccatcaatgtatggaaaaaatgtgtacagaacatgctgatcattcttgatattttggtgcagtacccaaacataatggttgatgattccgtggaaccggatgagaatgaaactcagaaaggtgctgaacataatggaacaattcgggtttggggtaacttagttgcttttttagaaagaattgatgtcgagtttttcaagagcctgcagtgcatagatcctcatacgcgtgactatgttgagagacttagggatgagcccacgtttctggttcttgcccagaatgtccaggaatatcttgaaagagttggaaatttcaaagccgcttctaaggttgccttgaggagggttgagctcatttactacaaaccccaagaggtttatgatgccatgagaaaattgactgaattgacagaagatggagataatggaggggaggcaagtgagaaggaatttgaggaatcaaggattcctactgcatttgtagttaccccagaggttgttacacggaaacccaccttccctgagaatagcaggaccctaatggatatattggtatctatgatatacaaatatggagatgagcgaactaaagcacgtgcaatgctctgtgatatatatcatcatgctcttcttgatgagttttcaatagcccgtgatctgcttcttatgagccatttgcaagacagtgttcagcatatggacatttcaacgcagatactttttaacagggccatgtcacagttaggtttatgtgcttttcgggttggactgatttctgaagcacatggctgtctgtctgaactctactctggtggaagggtgaaggagttgctggcacaaggcgtttcacaaagtcgttatcatgagaagactcctgaacaggaaaggttggaaagaagacgacagatgccgtatcatatgcacatcaatctagagctcctagaggcagtacatctcgtatctgctatgctgctggaagtgcccaatatggcagccaatgttcatgatgccaaacggaaggtcattagtaagactttccgtcgcttgcttgaggtaagtgagaaacaaacatttactggtccaccggaaaatgtcagagatcatgttatggctgccacaaggattcttcgcaagggagacttccagaaggcttttgacattattgtgtctcttgatgtatggaaatttgtgagaaatcgagacacggtacttgaaatgctaaaggacaaaatcaaggaggaggcattgaggacatacctctttaccttttcttcatcttatgaatcgttgagcctggatcagctcacaaaattttttgatctctctgtttcgcgcactcatagcattgtcagtaggatgatgatcaatgaggagcttcatgcaagctgggaccagccaactgggtgcattcttttccaagatgtcgaacactccaggctgcaggcattggtattccaattgacagagaaattatctgtccttgcagagagtaatgaaaaagcaacagaggccagggtaggtggtggtggattggatctgcctctaaggcggagagatggccaggactatgctgccgccgctgctgccggcagtggaacagcctctacaggtgggtatggtggaagaccaatgacattaggccaagcagctgggagtggctattcaaggggacgaggaagaggttcgtatggaggttcagggaggacttctcaaaggggttcagcattgaggggaccccagggcgatggacctgctcgcatggttagccttaagggagttcgtgcttga

SEQ ID NO: 3442 - DNA, 384 bp, Glycine Max; identical to SEQ ID NO: 443

SEQ ID NO: 3443 - DNA, 1008 bp, Glycine Max
atggcttcatctttaaaccaacgcatggtattccctgttatggtcgtagttggtatgttttgcttattggtaactccttctattgccgaacttccaagattcaaacaccctccaaaaaaacaacaatctcttaatatattggtccttggagattggggaagaaaaggaacctacaatcaatctttggtcgccaatcagatgggaattgtgggggagaaactagatatagattttgtgatctccacaggtgacaatttttacgaagatggactaaaaggggttgatgatccagcattctaccagtctttcatccacatgtacactgcccccagcttgcaaaagacatggtacactgttctgggtaaccatgactacagaggcgatgttgaggcacaactaagtccaattctaaaacaaaaagatagcagatggctttgcatgagatcttttattctcgatggagaaattgtggaatttttctttgtggacacgactccatttgtcgaggagtacttcacggacccaggagaacatacctatgactgggaaggcgtgcttcctcgcctagcttacgtttcaaaactcttgaaggatgttgattcagctttggctcaatcaaaagcaaaatggaagatggtggtgggtcatcataccatcaatagtgctgggcatcatggtagcaccgaagatcttaaacagctacttgttcccatcttagaggcaaacaacgttgatgcatacataaatgggcatgaccactgcttgcagcacataattgacaataataatggaattcactttataacaagtggagggggatcaaaggcatggtcaggcgatgtcaagccgtggaaactggaagaactgaagttgtattatgatgggcaaggattcatgtctatgcagatcaccaaaagcactgcatatatcatattttatgatgcttttggcaaagttttgcatacatggagcatatccaaagaccgtaacgtagcagcctggatataa

SEQ ID NO: 3444 - DNA, 687 bp, Glycine Max
atggcttcatttgtttctacccactgtatccttcctagcggggttggatttgtgcatgaccaagatcgttcttgtggtagaactaacactttgcatcttcaaaatgctcctaaaagccctagctctctctcctttttgctctccgtgcgagaaagtagatcagatgccgttgttgttcagagcaagggtcgatcgtctttttctcaaacagctgctgtgaggcatcttacaggttctgttaccagagcccatggacttcgttttgctgtggttgttgctagatttaatgaaattgttaccaaaccgctcttggaaggtgctttgggtactttcaataattattcagttcaagatgaggatatcgatgttgtgtgggtacctggtagttttgaaattggtgttgttgcagaaaggcttggaaaatcaggcaaatatgatgcaatcgtatgcataggagctgtggtacgaggagatacaacccactatgatgcagttgctaattcagcagcatcaggagttctttcagccagtctaaactcaggtgttccatgcatatttggtgtcctaacatgtgatgatatggatcaggctctaaatagagctggtggaaagtctgggaataagggtgctgaggctgcattgactgctattgagatggcatctttgttcgagcaccatctgaagtag

SEQ ID NO: 3445 - DNA, 687 bp, Glycine Max; identical to SEQ ID NO: 3444

SEQ ID NO: 3446 - DNA, 558 bp, Glycine Max
atggcttcatttgtttctacccactgtatccttcctagcggggttggatttgtgcatgaccaagatcgttcttgtggtagaactaacactttgcatcttcaaaatgctcctaaaagccctagctctctctcctttttgctctccgtgcgagcttcagaaagtagatcagatgccgttgttgttcagagcaagggtcgatcgtctttttctcaaacagctgctgtgaggcatcttacaggttctgttaccagagcccatggacttcgttttgctgtggttgttgctagatttaatgaaattgttaccaaaccgctcttggaaggtgctttgggtactttcaataattattcagttcaagatgaggatatcgatgttgtgtgggtacctggtagttttgaaattggtgttgttgcagaaaggcttggaaaatcaggcaaatatgatgcaatcgtatgcataggagctgtggtacgaggagatacaacccactatgatgcagttgctaattcagcagcatcaggagttctttcagccagtctaaactcaggctctaaatag

SEQ ID NO: 3447 - DNA, 693 bp, Glycine Max
atggcttcatttgtttctacccactgtatccttcctagcggggttggatttgtgcatgaccaagatcgttcttgtggtagaactaacactttgcatcttcaaaatgctcctaaaagccctagctctctctcctttttgctctccgtgcgagcttcagaaagtagatcagatgccgttgttgttcagagcaagggtcgatcgtctttttctcaaacagctgctgtgaggcatcttacaggttctgttaccagagcccatggacttcgttttgctgtggttgttgctagatttaatgaaattgttaccaaaccgctcttggaaggtgctttgggtactttcaataattattcagttcaagatgaggatatcgatgttgtgtgggtacctggtagttttgaaattggtgttgttgcagaaaggcttggaaaatcaggcaaatatgatgcaatcgtatgcataggagctgtggtacgaggagatacaacccactatgatgcagttgctaattcagcagcatcaggagttctttcagccagtctaaactcaggtgttccatgcatatttggtgtcctaacatgtgatgatatggatcaggctctaaatagagctggtggaaagtctgggaataagggtgctgaggctgcattgactgctattgagatggcatctttgttcgagcaccatctgaagtag

SEQ ID NO: 3448 - DNA, 2157 bp, Glycine Max
atggcttccaatattcatgatgaatctgtttcatcagctccaacacgtgcttatgaaactaaacccagttcaaaatcaataccccagcaaagtgtcatagacattgaagccaccacactagaaatggaagcttttagaggcccaagaaagatcaatggatcagctggtgagactcagaaagaagagattggtatctgcttgacatggaaggatgtatgggtgactgcttccaatagaaagagtggaagcaaatcaattcttcacgggctaactggttatgctaagccagggcaactcttggcaataatgggtccctctggctgtggcaaatctactctacttgattctttagcagggagattaggttcaaacacaaggcaaaccggggagattctgatcaatggtcacaaacaagcactgtgttatggaacctcagcatatgtcacacaagatgatacattactcaccaccttaacggttagagaagcagtgcactattcagctcagctccaattacctgacaccatgtccaaagaagagaagaaagagagagcagatttcacaatcagagaaatgggtcttcaagatgccattaacacaagaattggagggtggggttgtaaaggcataagtgggggtcagaagaggagagttagcatctgcatagagatcctaacacgcccaaaacttctctttcttgatgaaccaactagtggacttgatagtgcagcttcctattatgtcatgaaaagaatcgctgcccttgctcaaaatgaccacattcagagaactgttattgcgtcaatccaccagcctagtagtgaagtttttcaactcttccatagcctttgtcttctgtcttcgggtaaaacagtttattttggacctgcttctgctgcaaaggagttttttgcttcaaatggttttccttgtcctcctctcatgaatccatctgatcatttactgaaaactataaacaaggattttgatcaggtaattctaagtttccatggcattggtgcttttttcaccattcagcacaagatatctgatattgaagcgggtttagcaggaactgaaaacatactcacagaagaagtaatccacatccttgtgaactcatacaaatcatctgaaaggaatcaagaagttcaaaatgaagtagctttactatctaagaaggacaccagttcattggatatgaagaaagggaatgcaggcttccttaatcaatgcttagttctaaccaaaagatcgttcattaacatgtatcgtgatctaggctattattggttacgccttgtcatatatattgcattggccataactttagccactgttttctatgatttgggaacaagttatgactcaattaaggatcgaggttcacttgttgctttcataaatggattcattactttcatgaccattggtggatttccttcctttgtggaagtcatgaaggtatatcaacgagaaagacaaaatgggcattatggtgtgactgcatttgtcattgggaacaccttgtcatcaatcccatacttgctaatggttacattcattcctggggctatatcttattaccttcccggtcttcagaatggatgcgaacattttctgtatttcatttgtgttttattttcaagtctcatgttagtggagagtcttatgatgatagttgctagtgtggttcccaactatcttatgggcatcattgctggttctggaattcaaggaatcatgcttttacttagtgggttctttaaattgccaaatgatattcctaagccagtttggaagtacccattacactatgttgcttttcatacgtatgccaaccaaggaatgttcaagaacgaatataaaggactaagatttaatacagatcatcaagttggatcaggaggctcacatggttacataagtggtgaagaggttttaagaaatacatggcaagttgacacgagttactcaaagtgggttgatctagcaatcttgattggaatgattgttgtatatcgagttttgtttttggttatcatcaagattaaagagaagatgaagccccttgttgtatcattatcgtgcatgtcagcctctcccaagagaacaatgcaggtcatggaaaaccccaacgccactcctttacattga

SEQ ID NO: 3449 - DNA, 870 bp, Glycine Max
atggcttccgacacggccaaaggactctcaatcgaagaggcaaccgtttatgatctccaacttgcttttcggacaaaacaactaacctctagggaagtcgttgacttctacctcaaacaaatagaaacgcaaaacccagttctgaaaggggtgttggagttgaacccagatgcactatcacaagctgataaagctgaccatgagagaaagactaaggcaccggggtctctttcaccactgcatggaatacccattttgattaaggacaacattgcaaccaaggataagatgaacaccactgcaggctcttttgctcttctgggctctgtggtgcctagagatgcaggtgtagtttccagattaagagaagctggggctatcattttaggcaaggccagcatgagtgagtgggcattttacaggtccaatgcagcacccagtggttggagtgccagaggtggacaggggaagaatccatacacaatggatggtccaagtggatctagtagcggatcagcaatatcggtggcagcaaatttggtggcagtgtcccttggtactgagactgatgggtccattttatccccttcaaacgttaactcagtagtgggtatcaaaccaacggttggtctcactagtagagcaggggtagttccaatcaccccaagacaagacacagttggaccaatttgcaggactgtatcagatgctgctcttgttcttgaaaccattgcaggcatcgacatcaatgatcaggcaacaattgaagcatcaaaatatgtcccagaaggtggctatgctcaatttctaaagaaaagagggactgagaggaaagagattaggtgttgtgagatttttctacggttttag

SEQ ID NO: 3450 - DNA, 1626 bp, Glycine Max
atggcttcctcggagatcgaggtggtttcatcatcatcatcggtctccaaacccaacaacgaccagcctccaatcctcgacgttttcaccgcctctgctcacggcgacttcaacaaattgagaaccttcgtcgaacaagacggtgcctccgtctctcttcccgattttagcggctattacgctcttcagtgggcctcgctcaacaactttcacgacattgcgcactatctcattcagcatggggcggatgtcaatgctaaagacaacatgcaacaaacggcattgcactgggcagcggttcacggttcaactctagctgctgatgtgcttgtggagaacggtgctcgggtcgaagctgcagatgtaaatggataccgggcagttcatgttgctgcacaatttggacagacagctttcttaaatcatattgtagtaaagtaccatgctgattttgatgtgcctgataatgatggaaggagtcctcttcattgggctgcatataagggatttgctgacacagtaagattgcttctatttagagatgcaagtcaaggaagacaagataaagatggttgtacaccgttgcactgggctgcattaaggggaaatgcagaggcatgtgctgtgcttgtacatgcaggcacaaaagaagaactgatgatgaaggacaatgctgggaacacacctgtacagcttgcatatgataaaggtcatcggcatgtcgctcctttcctttcaaatcaacaacgggctcatagcaactactggaaagggaaactgtgtagtgggatagtgacagatattggttatgctcccatcttattctgtactataatctttctctcaatcctcttcatcaactcagttgttgcagctcctaaccttaaaaagattactgctgttgttggactttgggcatggacagcgctttcttcggctgttggttccctgattatgttctataagtgcagtagtaaagatcctggttatataaaacgactgggagaattgggtactcaaagtgatacagaggatcctttattgaatattgatctgaatagttcctctgtttggatgggaaattggtctcaactttgccctacctgcaagataataagacctgtccgatctaagcattgcccaacttgtaagcgatgtgtggaacagtttgaccaccactgtccatggatatctaactgtgttgggaagaggaacaaaagggatttctttatttttatctgcctgggaactttgacttcttccctttctggtgccgttgcagttcaaagaatttgtacatctaaaccagcattactggcaggagaaacatggatccattatgtgttagtaagacatctaggtttagttgtgtttttggtgatggatgctgttgtttttgttgcgactacgacattaacgataacccaggcttccatgatagctcgaaatgtgaccacaaatgaactagcaaattcctcccgttatgattatcttcgtggtcctgatgggcggttcagaaacccatacaaccacggttgttggaagaattgtgctgacttcttttttctcggctatacaaatgatgatgagattgcttggcctccattacagcaggtggcaacttag

SEQ ID NO: 3451 - DNA, 2274 bp, Glycine Max; identical to SEQ ID NO: 444

SEQ ID NO: 3452 - DNA, 2148 bp, Glycine Max; identical to SEQ ID NO: 445

SEQ ID NO: 3453 - DNA, 2007 bp, Glycine Max; identical to SEQ ID NO: 446

SEQ ID NO: 3454 - DNA, 549 bp, Glycine Max
atggcttctaagatcttctatctattatctctcctcttgctagcacaccttcttcagccacacgtatttgttaaaggagatggcagtttgatagagaaaacctgcaagaacaccaagtactacaatctgtgtttctcctccctgaaatccaatccaagcagcgcaaacgcggacccaaagggcttggctgtgatcatggttgggattggaatggccaatgccacttccacttctctctatttgtcttctaagatgcttggcactgccaacaacaacgattccaccttcaaaagggtgctgaaggagtgtgcagaaaagtacaagtatgccagtgatgccctccaagcttctgctcaggatttggttaatgaggcatatgactatgcttccatgcacatcattgcagcctatgattactccaatgtttgtcacaacttgttcaaactctactcgggtttggtttatccttctgagcttgctcctagagaggatggtttgaagtgtttatgtgatgttgctttggggattgttgagaatcttaatcggtag

SEQ ID NO: 3455 - DNA, 249 bp, Glycine Max
atggcttctcactctcatagttgcatcattttggctttgttcattgctatttccttctcaagcatggacatggcattagcaacacgccatctctcacctttcccaccactgccacctttgccagcaaccccaccattattgccaccattgccacctgtgccaacagtcccaatcccaattacactgccacctttgccaccaactccaccattgccaccaactccacctttgcctaggattacaacctag

SEQ ID NO: 3456 - DNA, 507 bp, Glycine Max
atggcttctcctggtggaagtgggacctattcatctggttcaagttctcttcaaaactctggttctgagggagacagagacatcatggaacagaggaagaggaagagaatgctatccaatagggaatcggcacgtagatcgaggatgaggaaacagcagcacctggaaggtctcagtgcccaattggatcagctaaaaaaggagaacacccaaatgaacacaaacataggcatcagcacgcagctgtacctcaacgtggaagctgagaacgcgattctgagggctcaaatggaagaactgagcaagagattgaactctctgaacgaaatgataagtttgattaactccaccaccaccaccaacaactgcttgatgttcgatgaggcacaggagactacgactcagttgttcaatgattgtggcttcatggatgcttggaattacggaataccactcaatcaacaaatcatggcttacgctgacaatgacatgttgatgatgtattga

SEQ ID NO: 3457 - DNA, 633 bp, Glycine Max
atggcttctctgggcactagtagcaatgaaatgtcaattgaccatattgagattctcatcatacattctaatgatatagaagcaaagcctagccaatacattgaagaaaacaatattgagtactgtcaaagggcgcagtggcttggagctgtgtttggagccaaaaatgggttggtcttaatcaccttattgatgatggccgttgaagctttgaatgaagacatcacaaccatgcttcttgccggcttcgcaggactagttgttggggctagcggtatggcaattgaagaatatgtgtgcgctcaattagacacagaggtagctgaaatgaaagtccacaataacaaacacaaagaagtggaggaagatgacgaacaacttaacccttttcaggcttccatagcatcagcaattggattttctgttggtgctgctgtgtcagtgctagcagctgtttttataagggactataagatcaggttattggtttttgctgtgtccatcttggcatttttcgtatttggaggtgtaggaacagtacttggtgaaagtaaaacaccagtgagaaggacttgtgattgtgatagtgctgattggaggttggatgactatggctattacttttggctttga

SEQ ID NO: 3458 - DNA, 858 bp, Glycine Max
atggcttctgaaggcgaccatcaccaccaccaccaccaccatcaagatcacgatcatcatcatcatgatcatgatcaccatcatcatcacgatggagagggagagaccaactcatgggtaggtaaggatgggaaggtgtaccatagccacgatggtctggcgccgcattctcacgaacccatttactcccccggctacttcaccagaagagctccaccgcttctcaacagaaacttcaacgaaagagccttcaccgtcggaatcggtggacccgtcggtactggcaaaacagctctcatgttggccctttgtgaactcttgcgcgaaaactacagtctcgcagctgtgacaaatgatatattcactaaagaggatggtgagttcttggtgaagcacaaagcacttcctgaggaaaggatacgcgctgtagaaactgggggttgcccacatgctgctattcgggaggacatcagtattaatcttggaccgctggaggagctttctaacctcttcaaagcagatatacttctttgtgaatctgggggagataacctggctgccaatttcagcagggaattggctgactatattatttacataatagacgtgtctggcggtgataaaattcctcggaaaggtggtcctggaatcacgcaagctgatctccttgtgataaacaagactgaccttgctcctgcaattggggctgatttggcagtcatgcagcgggatgctctgcggatgagagatggagggccatttgtctttgcacaggtgaagcataagattggagtagaagaaattgggaatcttgtcttgcaggcatgggaagcagccacagggaataagcgtcattaa

SEQ ID NO: 3459 - DNA, 825 bp, Glycine Max
atggcttctgaaggcgaccatcaccaccaccaccaccaccatcaagatcacgatcatcatcatcatgatcatgatcaccatcatcatcacgatggagagggagagaccaactcatgggtaggtaaggatgggaaggtgtaccatagccacgatggtctggcgccgcattctcacgaacccatttactcccccggctacttcaccagaagagctccaccgcttctcaacagaaacttcaacgaaagagccttcaccgtcggaatcggtggacccgtcggtactggcaaaacagctctcatgttggccctttgtgaactcttgcgcgaaaactacagtctcgcagctgtgacaaatgatatattcactaaagaggatggtgagttcttggtgaagcacaaagcacttcctgaggaaaggatacgcgctgtagaaactgggggttgcccacatgctgctattcgggaggacatcagtattaatcttggaccgctggaggagctttctaacctcttcaaagcagatatacttctttgtgaatctgggggagataacctggctgccaatttcagcagggaattggctgactatattatttacataatagacgtgtctggcggtgataaaattcctcggaaaggtggtcctggaatcacgcaagctgatctccttgtgataaacaagactgaccttgctcctgcaattggggctgatttggcagtcatgcagcgggatgctctgcggatgagagatggagggccatttgtctttgcacaggtgaagcataagattggagtagaagaaattgggaatcttgttctctcttaa

SEQ ID NO: 3460 - DNA, 783 bp, Glycine Max
atggcttctgaaggcgaccatcaccaccaccaccaccaccatcaagatcacgatcatcatcatcatgatcatgatcaccatcatcatcacgatggagagggagagaccaactcatgggtaggtaaggatgggaaggtgtaccatagccacgatggtctggcgccgcattctcacgaacccatttactcccccggctacttcaccagaagagctccaccgcttctcaacagaaacttcaacgaaagagccttcaccgtcggaatcggtggacccgtcggtactggcaaaacagctctcatgttggccctttgtgaactcttgcgcgaaaactacagtctcgcagctgtgacaaatgatatattcactaaagaggatggtgagttcttggtgaagcacaaagcacttcctgaggaaaggatacgcgctgtagaaactgggggttgcccacatgctgctattcgggaggacatcagtattaatcttggaccgctggaggagctttctaacctcttcaaagcagatatacttctttgtgaatctgggggagataacctggctgccaatttcagcagggaattggctgactatattatttacataatagacgtgtctggcggtgataaaattcctcggaaaggtggtcctggaatcacgcaagctgatctccttgtgataaacaagactgaccttgctcctgcaattggggctgatttggcagtcatgcagcgggatgctctgcggatgagagatggagggccatttgtctttgcacaggttagttaa

SEQ ID NO: 3461 - DNA, 348 bp, Glycine Max
atggcttcttcagggacaagagcagcctcaggcttcagcttctcagagatctggctcttgatagtagccacagcactcatctgtggctttctcgggtacatagtttatgatgcaatcatggccactgcttctgagttgctgcaacgtttgctggtaatttctccactgttcttgatcatcattgttcactggctctccactgcaacccaaataagcttccccatgccaggatctgagcctagtgccatccacagagctggtggttccccttggggtgttgcctttgttcttcttctgcttttccttctcatttcttaccaaccttccctgcatgaccttatttcttag

SEQ ID NO: 3462 - DNA, 2025 bp, Glycine Max
atggcttcttcttccatttccgcaccaacgctcaccttcccgacgcagaagcttgccgttccgttccccgcgccccggacgccctcgctcctcccgttcccatcgcaacccccctgccgctgcctcgcctctgcctcctccgacgaccgctgttccggcgccaaacgcagcggctgggactccgtgctgcaccagttctccgaggtcgccaagcgagtcgattcctactggaagtccctcgggaacgccgccgctgacgatcgcgtccgcgtcgtcggtggcgacgaggattgggattgggatcgctggcgccggcatttcgaggaaatcgacgagcaagagcgcctcctctcgattttcaagtctcagttaagccgtgccgtgtatttggagaattatgaagatgctgccaggcttaaggttgcatttgcagctacagctaacaacgacagtgttggaagagtgatgtcttatctcaatagagccataaaagaggagcggtatggtgatgcagctttcttaagagataaagctggcgctggacttgtgggttggtggtctggtatttcagaaggtgtaaatgatccacatggtctaattattcgcataactcctgagcatggaagatatgtggcgaggagttatagtccaaggcaacttgcaacttctgctgctggcattcctctttttgaattttttcttacaatggataaaaaaggtgaattcaagtcacaggctgtgtacttaaagcaaagaggggccttccatggacccccaacaacctcctctaaaacattggatgctgctgggagactgagttcagtggagtctactgaagacaaaagtgagctgtttgttgtgagtactgaagatccagaaaatggtaatgataggaatgatggctctgatcctgctgagggaatgcctggatttcagaatgtcttgaaagatatgattcctggggtaaaggtgaaggtattcaaggtgataactccagagaaagtagacaaggatctatctaatgtgattgagaagataattgaggacgaagacggagacgaagacgaagatgaagagatggaaaatgatgcagaaagtctagaactggaagagattaagtctgagactgaccaggagggagatgatgagattgaaataaatgctggtctgggaacttttgaacgtgaagaccagaatgagtttgctgtcaaaattgccattggtggtcttgttcagaaactttctggtaatctatcctctagagatttgcttcgagtccctgctatgctggagatgaaggggcgtggttcattttcctttactgttgaaaaagaagtcaatcagcaggttggtcttgacaaaggaaaatcttcatctgataaatcaactaagtttcaaggtcgacgcagagttgatcatgttatttttgaccttgcaaaattcattggcaggggaaagataccctcaaaggtgctgaaagaagtgggagaattgataaatctcactctaagtcaggctcagagccatcaccaattatctggctcaacaattttcaatcgcatcgaaataccagcttcgtttgatcctttaaatggtctatacattggtgcacatgggctttactcctctgaagttattcatctaagacgtagatttggtcagtggcaagaggacaatggggctaaggagccttcaaatattgagttttatgagtatgtagaagctttgaagctaactggggatccttatgtaccagctggccaggtggcatttcgtgcaaaaattggaaagaggtatcaattgcctcataaagggataatacctgaagagtttggcgtgattgctcgctataaaggtgaagggaggctggctgagccagggtttcagaatgcccgatgggttgatggtgagcttgtgattcttgatgggaagcacctaaaagcagggccggttgttggatttgtgtattgggcccctgggtatcattttttggtcttcttcaatcggcttaggcttcaacagtag

SEQ ID NO: 3463 - DNA, 411 bp, Glycine Max
atggcttgcaccaccgtcgtgttgacgctagtcgccgcattgttggtaacctccgtcgtggctcagtctccggcgtcctcaccagctctgtctccaaagcgcacccccgtcgccacacctcagaagtctccctcgccggcgatttctccctccgccgtgtcgccgtcgtcctctcctcccgctccggtggtgaacactccgtctccgtcaccaaactcagtcgactctccgccatctcctccgcagtctccgtccgtgtcaccagccggtgttccctccgtcactccttcagcaatctccgctcctcccactggagcaccggctccctctcaaaacggtgccgctttgaacagattcactgttgctggatctgctgctgttgtggttttcgctgcggctttgctcatgtag

SEQ ID NO: 3464 - DNA, 510 bp, Glycine Max
atggcttgcagggtgcagaaaagaatttcgctgcgcagaaaacttcacattctccgagtccttacctactcaaactctgccaagagaacctcccttgccaagagtaccgttctacgcttatacaagctaaagctcgcactggaaactgtcaaaagacagtatgaaaacctattagccaccagaagagagtgcgttaggctattgaaccatgtcaaagagagcaaggatgtgaaaatagagaaggtaggggcaggaacttttatggtgagggtcacatgtgagaaaggaggtgacaatctggtggctatattaaaggcatttgatgagatgtgcctggatgttcagcaagcgagagtttcatgtgaaaatggtttttttctggaagccattgctgtggctgaggaccaaacgctggatgtaagagatatcactgaagtgcttctaaaagcaattggaaagcagagtggtgaaaaggactcgcagatgtttgacaaatgctgtgattcgtga

SEQ ID NO: 3465 - DNA, 624 bp, Glycine Max
atggcttgtcaaatgggatctacgattctgaaatggagattatcaattacagattataaaagctctgaaaattcatgtatagcccttgcaacttccagaatccactgttgttgctgtgagacaaattttaacaggctaactctaaatggcacaaagtcttcacctttttctcagagctgtttcttgggaagaagagctgggtggaaaatagcttttgccttgaacacaggtggagtgtctggaaatggtgaccaacaaagcttcaacgaagccagttccaatcttggtggtactcgattgggtaggatactgagtgcgggtggcagacaacttctagaaaagctgaacgcagctagaaagaatatccctttgaaagtattcctgctacttttgggtttctacacggcaaatgcactagctacaatccttggacaaactggtgactgggatgttctggttgctggtgttgtggtagctgcaattgaggggatcggcatgctaatatatagaaagccgcctactgagaagactgggaggttgcagtcttttctagtgctggtgaactactggaaagctggcatatgtttaggtctctttgtagatgcttttaagttaggcagctaa

SEQ ID NO: 3466 - DNA, 282 bp, Glycine Max
atggctttccgcatatcaggcattattagacgagcatcgttttcttcaacccaagcagcctccaagggggttgaagtgccgaaaggctatcttgcagtctatgttggagataagatgaagcggtttgtgattccagtatcatacttgaaccaatctttatttcatgaattactaagtcaagcagaagaacaatttggatatgatcatccaacaggcggtctcacaattacatgtcaggaggatgagttcctaaatgccacttcttgcttgaatgagttgtaa

SEQ ID NO: 3467 - DNA, 465 bp, Glycine Max; identical to SEQ ID NO: 447

SEQ ID NO: 3468 - DNA, 498 bp, Glycine Max; identical to SEQ ID NO: 448

SEQ ID NO: 3469 - DNA, 1458 bp, Glycine Max
atggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagaccctcaccgcccttggcgccgaggtccgctggtgctcctgcaacatcttctccacccaggaccacgccgccgccgctattgcccgcgacagtgccgccgtcttcgcctggaagggtgagaccctccaggagtactggtggtgcaccgagcgcgccctcgactggggccccggtggtggacccgacctcatcgtcgacgacggtggtgacgctacccttctcatccacgaaggcgtcaaggccgaggagctctatgagaagaccggcgaactccccgaccccaactccaccgacaacgccgagtttcagatcgtgcttaccatcatcagagatgggttgaagaccgatcccaccaggtaccgcaagatgaaggagcgtctcgttggggtttctgaggaaaccaccactggagttaagaggctctatcagatgcaggcgaatgggactcttctcttccctgctattaatgtcaatgactctgtcaccaagagcaagtttgacaacttgtatgggtgccgtcactctctccctgatggtctcatgagggctaccgatgttatgattgctggaaaggtggctgttgtggctggatatggtgatgttggcaagggttgtgctgctgcaatgaagcaggctggtgctcgtgtcatcgtgaccgagattgatcccatctgtgcccttcaggctctcatggaaggccttcaggttctgaccttggaggatgttgtttctgaggctgatatctttgtcaccaccaccggtaacaaggacatcatcatggttgaccacatgaggaaaatgaagaacaatgccattgtttgcaacattggtcactttgacaatgagatcgacatgcttgggctggagaactaccccggcgtgaagcgcatcaccatcaagccccaaactgacagatgggtcttccctgagaccaacaccggtatcattgtcttggctgagggtcgattgatgaacttgggatgcgccactggacaccccagttttgtgatgtcctgctccttcaccaaccaggtcattgctcagcttgagttgtggaaggagaagagtaccggcaagtacgagaagaaggtttacgttttgcccaagcaccttgatgagaaggtggctgcacttcacctgggcaaacttggagctaagctgacccagcttagcaagtcccaggctgattacatcagtgtgcctgttgagggtccatacaagcctgctcactacaggtactaa

SEQ ID NO: 3470 - DNA, 732 bp, Glycine Max; identical to SEQ ID NO: 449

SEQ ID NO: 3471 - DNA, 792 bp, Glycine Max
atggcttttcttctaccaaacgtccaaccttctcttttagctcaatccaaatccaagaaagacaaagcaaaccttcaccaaactctctcacctcaaaaacccacttctcagtttcctatatcatccaccacatgctcttcttctctacaaacttccactgcacaagttgcaaaagtcagcacaccacatgataagcagcaacaacagccaaaggatgaattctacctcaaccttggtcttgatgtcaggacaatccgtgaggaccttcctttgatcttcatcaaagacctcaattatgacatttatagggatgacataacattcatggaccccttgaacacatttactgggattgagaagtacaagctgatcttctgggcattgaggtttcatggcaaaatcttgttccgagagattgcacttgatgtgtacagggtgtggcagccttcagagaatgtgatattggtcaggtggaaccttaggggtgtgccgcgggttccctgggaggctaaaggagagtttcagggcacttcaaggtacaaattggacagaaatggcaaaatttatgaacacaaagttgataacttggcattcaatttcccacagaatattaaaccagtttcagttttggatttggttactgcatgccctgcaagtccaaaccctacctttttgtggggtcctgttgatgcatactcttcttcatggataaccttttacaaggcaattagggagacattggatcaagaaaggagtttgctaccacaagatggtctagctacatgttcatag

SEQ ID NO: 3472 - DNA, 582 bp, Glycine Max
atggcttttgcttcttctcctcctcttttccctccatcgtcttcctcgtcgccaacttctttgaagcagttttcgcattcgatttctcataaactacatgtgacaaattatcttctatggcttcaacaagttgagcttgtgatcaagagtcgtcatcttcatcactttcttgttaatcctttgattccaaaaaaatatgcccttgtcaaagattgcgattctgatacaactactgaggtgtatcatggttggaaagaacaggaccaattctttcttgcttggctccgatcgaccatttatggtgatatgcttacgcatgttattggttgcaaatcgtcgtggcagctatgggatcgtcttcaattgcattttcaatctcttactcgggctcgtgttcgtcagcttcgcaatgaactccgatgtctctcccatggtaatcgctccaccaccggttatcttctttatgttcagaatccggttaatgaaatcacttggattagtgaatcgatgtcttcatctaataagcatttgaatttgattctttacggtcttcggatgagtatgacccatccatctcgatga

SEQ ID NO: 3473 - DNA, 1608 bp, Glycine Max
atgggaaaagagaaactaagcttcaaagaagttcaccattctcatagtcccaaaactactctatggtggttctttcttgtagctacctgcataaaagttctccttttcccatcctatcgtagtacagattttgaagtgcaccgcaactggctggctttgactcactccctccctctttcccagtggtactttgatgagacaagtccatggactcttgattacccaccattctttgcctattttgaacgatttctatccatttttgctcacctcattgatccccaaatagtgcaccttcagaatggccttaattatagctccaacaaggtggtttatttccaaagagttactgtaatactttcggatttgtctcttctttatggggtttacagacttactcggaatctggattcaagaaagcagcagttgatctggtcattggttatttggtcacctatgctttttatagtggaccatgtgcatttccagtacaatggatttctcattgggattttgttgatctcactttcatatttggaggaaggaagggatttgttaggtggttttgtttttgctgttctcttgtgctttaagcatttatttgcagtggcagcacccatatattttgtttatttgttgagacactattgttggggtggaatggtaagaggcttcaggcgacttttgattatgggaggagtggttacagcagtgtttgcatctgcatttggaccatttttccaccttggacagatacaacaagtcattcaacggttgtttccatttggcagggggctttgccatgcatactgggccccaaatttttgggtattctatatcatgtcagacaaagggcttgctttcatattcagaaaacttggctttaacgtccagacaccaacaggttcattcactgctggtctagtaggggattcctcaccattttctgtactacctcagatcaaaccatctgtgaccttcataatggttcttcttgccttatctccttgccttttcaaggcttggaagaatccacagccacagatgattagtagatggatagcctatgcttatacatgtggctttctttttgggtggcatgtacatgagaaggcatcactccattttgtaataccacttgcaattgttgcggcacaaactctggaggatgcaagacattactttttgctgtcaatagtatcttgctattcaatttttccactactatttgaggcacgagagtatccgatcaaagtattgttgctgcttctgcactccattttaatgtggtcaggattttcagcacaattttatgatggggctgaagctacaagagtgccaactgctaattcaaagaaaaaagctgatcaatttggatctgaaggtaattcgggtgcaactgtgaagaaaggttttgctattggctggattgagaggatttatctgataggtcttgtagttgtagagatatggggccaaattttacaccctctactttttggtgataagtttgcatttgcacccctcatgttgatctccatatactgtgcttttgggatcatgtactcttggatttggcagttgatatccatagttaaatgtcgttga

SEQ ID NO: 3474 - DNA, 1356 bp, Glycine Max
atgggaaacctctttggcaaaaataaaaagcgtgacactgaaagtgccaacaataataaaggaagaggtggaagaatctacactgccgtgaccacaagaggcttaccacctcatttcccaacacaattacctcattcacagcctccaccgctattatatccaactctagaacctccgccaccgccaccgccgccgccgccgccaccggcactaccacaatccatgtccaagaaaccaagttttgcgagagttttcgctaaacaaagctcttcagtcatgaacaacaatcaatctgctgccaagaagtatgctttgattcgtgataacttctctacccttgaacaggtgactacagccctgaggaaagaaggattagaatcatcaaatctcatccttggaattgattttacaaagagcaatgaatggactggcagaatctcattcaataaaagaagcctgcatgctattggaagtacacctaacccttacgagaaggccatctctattattggcaagacattggctccctttgatgatgataacttgattccatgttttggatttggtgatgctactacccatgatcaagaagtgtttagctttcacagtgatcattcaccttaccatggctttgaggaagttttggcctgctaccagaaaatagttccaaacttgaaactttcaggaccaacttcttatgccccggtgattgaggctgctatagacattgtggagaaaaatcgtggccaattccatgtgttggttatagttgctgatggccaggttacaagaagtgtcgacacaagtgatggagaactcagtcctcaagaagaaaaaacaattaaagcagtagttgatgcaagcgcatatccgcttgcgatagttctggttggagttggtgacgggccttgggaagacatgagaaaatttgatgacaagataccagcacgtgattacgataattttcagtttgttaatttcacggaaatcatgtccaaaaacataagcccgtcggaaaaagaagcagcttttgctctggctgctctcatggagatccccttccaatataaagcaaccatggaattcggaatactcggacgtgtaacaggaagagcaaagagaatagttccaaaacctcctcctgttccttattctaggcctgcacccagcattaatacagcagcatcctccggagatgaccaaaaccaaacggcctgcccagtttgtttgaccaatgcaagagatttggcctttggatgtgggcacatgacttgcagagagtgtggacacaaattaactaattgtcccatgtgccgagagaggatcactagtcgtctcagggtgtacagcgggtga

SEQ ID NO: 3475 - DNA, 255 bp, Glycine Max
atgggaaactgtggtagcaatcccaagaccaatgaggcagtgtctgaacctgtgaccgagcaggttaaggttgagcagaatgagcagactagtgaagcaaatgttcttgagacccccgagaacaagtctctaggcaccttgctcaaccagaaagtagaggaggaaccaaagacagaggaagtaaaggctgaacccaagccagaagagcctcaagaagagaagtccaaagcagaagaagcaaagagtgaggcctaa

SEQ ID NO: 3476 - DNA, 555 bp, Glycine Max; identical to SEQ ID NO: 450

SEQ ID NO: 3477 - DNA, 555 bp, Glycine Max; identical to SEQ ID NO: 450

SEQ ID NO: 3478 - DNA, 507 bp, Glycine Max
atgggaaatgcagcttcatgcactccttccttgatatctaataatggggtcttgaagatcctattatcagatgggaggttagaggcctacaaaaaaccaatgagagctgcagaactgatgctagaataccctggacagtttgtttgtgactcttgctacctcaaagtgggacaccgcattcatgggctcctagctgatgaccaacttgaaaggcgcaagttttacttccttctaccaatggagctgctctactctgtgctaacccatgaagaaatgagctctcttaattacaaagcatccagggcaaccaagcacgcaacttttaacaacttgggaaagatttttccagtctttagtgaactttgtatgttcccttccgagcttaagagattagaagaagctgataatcagcttcagttggtaagggagccagaaccacctgtccaaaggtactccaagcagagatcttggagaccggcactggagaccgttgatgaaactctctga

SEQ ID NO: 3479 - DNA, 4857 bp, Glycine Max
atgggaacacctgtgaacatcatcgttggatcacaggtttgggttgaggatcctgaggatgcatggattgatggtgaggtgacacaaatcaaaggcaaaaatgccaccatcattgccacaaatgggaaaactgtggtggcagaaatttcaagcatataccccaaagatacagaggcaccacctgcaggagttgatgacatgaccaagctagcataccttcatgagccaggagtcctgcataaccttgcaactcgtttttctctcaatgagatatatacatatacagggaatatcttaattgcagtgaatccttttcgaagactgccgcatttgtatgacatccatatgatggagcagtacaaaggagcagcatttggagagcttagtcctcacctttttgctgtagctgacacatgttacagggcaatgataaatgaaaatggaagccaatccattttggtaagtggagagagtggagctggtaaaactgagacaacgaaaatgctcatgagatatctagcattcatggggggtagatctgctacagaaggaagaactgtagaacaacaggttttggagtcaaatccagtgttggaagcatttggaaatgccaaaactgtcaaaaacaacaactcaagtcgttttggtaaatttgttgaaattcaatttgacaagaatgggaagatttctggagctgcaatccgtacatatctcctcgaaagatcacgagtttgccaggtctctgatccagagagaaactaccattgcttttacatgctttgtgcagcaccaccagaggatgtcaagaagtacaagttaggggatccaaggcaattccactatcttaatcaatcaaactgttatcaagtatcgaatgtggatgatgcaaaagaatacttggagaccagaaatgcaatggatattgtaggcattagccaagaagagcaggatgcgatcttccgtgtggtagccgcaatcctccatcttggaaatgttgactttgtcaaagggaaagaagttgattcttccaaattgaaagatgataaatcactcttccacctccaaacagccgcagatttattcatgtgtgatgcgaaagcactggaagactcactttgcgagcgtgtcattgtaactcctgatggtaacattaccaaacctcttgacccagatgcagctgctttgagccgagatgccttggcaaagactgtctactccaaattgtttgattggattgtggacaagattaacagttcaattggtcaagattccaatgcagtaagcataataggagtccttgatatttatggatttgaaagcttcaaaatcaacagttttgagcaactatgcatcaacctaacgaatgagaagttgcaacaacattttaatcaggcaagaaatgcatttgtttcaacagcatgtattcaagatggagcaagaagagtacacaaaggaggaaatcaattggagctatataaaattaaaccagggggaattattgctcttcttgatgaagcctgcatgttccctaaatcaactcatgagacttttgcacaaaagatgtaccagacatataaaggacacaagcgcttcagcaagccaaaactttctcgaacaaatttcacaattaaccattatgctggagatgtcacatatcaagcagattattttcttgataaaaacaaagattatgttgtagcagagcatcaagctcttttatgtgcttccaagtgttcatttgttgctaatatcttccctcctttaccagaggagacatcaaagcaatcaaaattctcttccattggttcacaatttaagcaacaactgcaatctctcatggagacactgaacacaacagagccgcattacataagatgtgtgaaaccaaatacagttctgcagccaggaatctttgagaacttcaatgtcttgaaccaactaagatgtgggggagtacttgaggcaataaggattagttgtgctggatatccaacaaaaaggacatttgaagaatttcttgatcgctttggaatgctagttcctgatgtccttgatggctctgatgagaaaaaggcatctatggccatctgtgataagatgggtttaaaaggctatcaaatggggaaaacaaaggtatttctcagagctggtcagatggctgaattagatgcacgacgagccgaagtcttagctaaagcggccaaactcatacagagacaaatccgaacacatttaacgagaaaggagtttatcaccttgagaaaggccactattcatatccaaaagatttggagagctaaacttgcacgtaaactctatgagaatatgaggagggaagcagcttctatcaggatacagaaacacgtgcgtgcacacagagcaagaatgaattatacaacgttacaagcatcagctatagttattcaatcaggtttgagagcattagcagcaagaaatgaatataggtacagaagaagaacaaaggcttcaacaaaaattcagacacaatggagaagagcccaagctctttctggttacaaacagcagaagaaagcaactgttgcacttcaatgtctatggagagctaaagtagcaaggaaagagctcagaaagcttcggatggctgcaagagaaactggggcacttaaggaagcaaaggacaagttggagaagcgtgttgaggagcttacatggcgactggatattgaaaagcacatgaggacagatcttgaagaagctaaagggcaagagattgcaaaattgcaaaatgctttacaagaaatgcaaggtcagttagatgaagcccatgctgcaattatacatgagagagaagcagcaaaaatagcaattgaacaagcaccaccagtaattaaagaggtacctgttgtggacaacacaaagctagatttactgacaaataaaaatgaggagttggagactgaagtagaagagctgaaaaacaagattaaagactttgaagaaaggttctcagaagtcgagaacgagaaccaagaaaggctgaaagaggcagaagaagcacagcttaaagcaacacaacttcaggagactattgaaagattagaattgagtttgtcaaaccttgagtctgagaaccaggttctatgccagaaggctttggaagaatcaaaaaatgaagaactctttgaagagatcaaaatgtcccttcatttagggttagatgttttgatggacacaactcccttagcaaaagaggatacacaaatggtacaccaaaatgagcctggtgtaggtccagtatttgttcatgaaatagattttaaaaaatcagatgataacaacataactatggatattatgataaactgttccttcctttcattttataagtttttaattcactgcatttatatggttactttgcatttggtaccttctgtagagaaaatgcaagtgcaaccaagagttattgcagataatatgacttcacaaatcaagaatttggataatggaagttcaaccgaggaagaatggcaagcaagaaaagaaccgagagcaccagtcttcttgcttactaaacaaagatcactcacagataggcaacaggaaagtcatgatgcactgctcaagtgtcttacggaagataagcgatttgagaaaaacagaccagctgttgcttgtattgtatataaatcacttcttcattggagatcccttgaagcagaaaagactcatatttttgataaaattacacatgctatccgatcatctatagagagtcaagaaggaatccatgatctagcctactggctttcaacaacatcaacacttctgttttatctacaatgtacaatgaaggccagcaatacaactaaggcagtgtcacgtaatcgaaactcgcccgcctctttgtttggcaaaatggcacaaggtttacgttcatcttcaatgggcttggggatttcaagtggctacagtggaatggtggacaagacaaatggtcaatctaaagtagaagccaagtacccggcaattctgtttaagcaacatttaactgcatatgttgagaagatatatggaatgatccgtgatagtttaaagaaagagattagccccttcttaaatctgtgtatacaggcaccaagatccataaggactagatcaataagagggtcatccagaaacatccattcaaatattgttgcaaaacaacaggcattgcatatgtactggaaaggcattgtggacaagctagatactgccttgcgtatattgtctgataactatgttcctcccatcataacaaggaagatatttagtcaggttttctcattcatgaatgtccagctctttaatagtttgttgcttcgccgtgagtgttgttcctttagcaatggagaatatttgaaggcaggtttgcatgagttggaactatggtgtcttaaagcaacagaccagtttgctggatcatcttgggatgagctcaaacacatacgccaggctgtgggctttctggttttgcatcaaaagacccaaaaatctttggaggagatcacaaatgagctctgcccggtgttaagtattccacaaatatatcgtataggaactatgttctgggatgacaagtatggagcacatggattatctgcagaagtcattagcagaatgagagtgattatgacagaagactcaataaacatacacaacagctcattccttctagaggtggattccagcataccattcttaatggaggagatgttccggtcaatgagtgacatccgcctatcagacatggatgtggatccaccaccaatcctcaggcaaagatctgacttccaattcttgttgcaacaaatggatagtgactctcagtga

SEQ ID NO: 3480 - DNA, 939 bp, Glycine Max; identical to SEQ ID NO: 452

SEQ ID NO: 3481 - DNA, 726 bp, Glycine Max
atgggaagaggaagagtggagttgaagagaattgagaacaagatcaacaggcaagtgacctttgcaaaacgaaggaacgggcttttgaagaaagcttacgagctttccgttctttgtgatgccgaggttgctctcatcatcttctccaatagaggaaaactgtacgagttctgcagcagttcaagcatgctcaaaacgctagagaggtaccagaaatgtaactatggtgcgcctgaggctaatgtgtctacacgggaagccttggagttaagcagtcaacaggagtacttgaagctgaaggcacgttatgagtccctacaacggtcccagaggaaccttatgggagaagatcttggccctttaagcagcaaagagctggagtctcttgaaaggcagctagattcgtccttgaagcaaataagatcaacaaggacccagttcatgctggatcagctctctgatcttcaacgcaaggagcacttgctaagtgaggctaacaggtctctcagacaaaggttggaagggtatcaaataaatccactccaactgaatcccggagttgaagagatgggatatggcaggaatccagctcaaactcatggtgaagccctctttcaacaaatggagtgtgagccaacgttacaaattgggtatcagcctgatccagtatcagtggtgacagcaggcccaagcatgagcaattacatggcaggatggctaccatag

SEQ ID NO: 3482 - DNA, 903 bp, Glycine Max; identical to SEQ ID NO: 453

SEQ ID NO: 3483 - DNA, 687 bp, Glycine Max; identical to SEQ ID NO: 454

SEQ ID NO: 3484 - DNA, 678 bp, Glycine Max; identical to SEQ ID NO: 455

SEQ ID NO: 3485 - DNA, 687 bp, Glycine Max; identical to SEQ ID NO: 456

SEQ ID NO: 3486 - DNA, 288 bp, Glycine Max
atgggaagcgaggatgcgaaagatccgttcaaaggggtggattggaaggccgttggtggcgagatgcagcaaaatccgagtgctaaaccagcattgaagaaacgattaccaaagaaagttagggaaattcctgaattctatttccttccacgatggccgctacccaaagccattttattctgcagcgcatgcattggtggtggtgtagctgctggaatgcttttagagacctggattgaaaagaaagttaaagaagatggaggggttatatgggaatttgacaaataa

SEQ ID NO: 3487 - DNA, 1831 bp, Glycine Max; identical to SEQ ID NO: 457

SEQ ID NO: 3488 - DNA, 810 bp, Glycine Max
atgggaattgtgggggagaaactagatatagattttgtgatctccacaggtgacaatttttacgaagatggactaaaaggggttgatgatccagcattctaccagtctttcatccacatgtacactgcccccagcttgcaaaagacatggtacactgttctgggtaaccatgactacagaggcgatgttgaggcacaactaagtccaattctaaaacaaaaagatagcagatggctttgcatgagatcttttattctcgatggagaaattgtggaatttttctttgtggacacgactccatttgtcgaggagtacttcacggacccaggagaacatacctatgactgggaaggcgtgcttcctcgcctagcttacgtttcaaaactcttgaaggatgttgattcagctttggctcaatcaaaagcaaaatggaagatggtggtgggtcatcataccatcaatagtgctgggcatcatggtagcaccgaagatcttaaacagctacttgttcccatcttagaggcaaacaacgttgatgcatacataaatgggcatgaccactgcttgcagcacataattgacaataataatggaattcactttataacaagtggagggggatcaaaggcatggtcaggcgatgtcaagccgtggaaactggaagaactgaagttgtattatgatgggcaaggattcatgtctatgcagatcaccaaaagcactgcatatatcatattttatgatgcttttggcaaagttttgcatacatggagcatatccaaagaccgtaacgtagcagcctggatataa

SEQ ID NO: 3489 - DNA, 1872 bp, Glycine Max
atgggagaacagaatgacattacgctgacatgggagaatttggaagctactgttacaaatggaaagaaccgaaaactaattcttcatgggcttacaggttatgcccagccagggagacttttggctataattggtccttctggcagtggcaaatccacacttcttgatgctttagcaggaagattgacatcaaacataaagcaaacagggaagattctaatcaatggccacaaacaagaactggcttatggaacatcaggctatgtaacacaagatgatgctatgctgtcatgtttaaccgctggggaaactttatactactcagctatgctccaatttccaaacaccatgtctgtagaagagaagaaggaacgagcagatatgacactgagagaaatgggtctacaagatgccatcaacacaagggttggagggtggaattgtaaaggcctcagtgggggacaaaggaggagacttagcatttgcattgagattctaacacacccaaaactcctcttccttgatgaaccaactagtggacttgatagtgcagcttcctattatgttatgagtggaattgcaaatctaattcaaagggatggaattcaaaggactattgttgcttccgtccatcaacctagcagtgaagttttccaacttttccatgacctttttcttctctcttccggagagacagtatattttggtcctgcctctgatgcaaatcagttttttgcttcaaatggttttccttgcccacctctatataatccttctgatcactacttaaggatcataaacaaagatttcaaccaggatgctgatgaaggaattactactgaagaagcaactaaaatccttgtcaattcttataaatcttctgaatttagcaatcatgttcagagtgaaatcgcaaaaagtgaaaccgacttcggtgcatgtgggaagaagaagaaaatccacgctgcattcattactcagtgcctaatccttataagaagagcttcactgcaaatctatcgtgacacaaacaattattgggcacgtttagttgtctttatcttcatatctttaagcgtgggctctatcttttatcacagtggcggcccggatttgcgatcgattatggatagaggatcgctgctttgttttttcgtttcagttgtgactttcatgacacttgttggtggaatctctccattaatcgaggaaatgaaggtgtttaagcgagagagactgaatgggcactacggtattacggcttttctcataagcaacatattctctgctgttccttacaattttttgatgtcaatcattccgggagctgtggttacttatctttctggactacataaaggagttgataactttgtattccttatttctgttttatttgctaccgtgacttgggttgagagccttatgatggttgttgggagtgtttttccaaactatgtcatgggcgtgatcgtatgtggaggaattgaaggagtcatgattttaacaagtggattctatcgacttccaaatgatcttcccaaaccagtgtggaaattccctttctactacatttccttcctcacctatgctttccaaggactgttaaaaaatgaatttgaagacttgccattttcttcggaagttctagctgacacttggcacgtgcaaatgggtcactctaagtgggttgatcttgctatcatgtttgccatgattgttctgtatcgagttctattcttggccatcagtaagtgcaaggagaaatcaaaacaagttagtgttggcattaaacccgaaactaaaattttctccagaatcaacatcagtgaactccaaatgaggggaattgatgatcataatgctgtctaa

SEQ ID NO: 3490 - DNA, 906 bp, Glycine Max
atgggagacgagaataagaccaagtcccctgcttccggcgtgtggtccaccatcaagcctttcgtcaatggcggagcctccggcatgctcgccacctgcgtcattcaacccatcgatatgatcaaggtgaggattcaacttgggcaaggatcagctgcgcaggtcacttccaccatgcttaagaatgagggtgttgctgccttctataagggtctatctgctggattactcaggcaggctacatacaccactgcccgtcttggatcatttaaaatcttgacggccaaagctattgaggctaatgatgggaagcccctgccactgtatcagaaagctctgtgtgggctgactgctggtgctatcggagcaagtgttggtagtccagcagacttggcactcattcggatgcaggctgatgcaacattacctgctgctcagcgccgaaattacacaaatgccttccatgcactctatcgaattactgcagatgaaggggttttggcgctttggaaaggtgctgggcctactgttgtaagagccatggcattgaacatgggcatgcttgcatcttatgatcaaagtgttgagttcttcagggattctgttggtcttggtgaaggtgctactgtgctaggtgcaagttctgtttctggatttttcgcagcagcttgcagtttaccatttgactatgtcaagacccagatccagaagatgcaacctgatgctgatgggaaatatccatacactggctccgttgattgtgctgtcaaaaccttcaaagcaggaggaccattcaaattttacaccggattccctgtctattgtgttaggattgctcctcatgtgatgatgacatggattttcctgaaccagatacagaaattgcagaaatcctacgggttgtag

SEQ ID NO: 3491 - DNA, 954 bp, Glycine Max
atgggagagctggccactgagaaacatgttcgatatatattatcagttgaaaagaggaaagataactttgaatctgtagtaatggagcatctgagaatgaatggggcatactggggattgaccactctggatcttctaggaaagcttcattctgtcgatgttgatgaggttgtttcatggttgatgagttgtcagcatgagtcagggggatttggtggaaatgttggacatgatccgcacatcctgtatacactaagtgctgtgcaggtgttggctctctttgataagctgaatgttattgatgtagataaggtcacaagttacattgtcagcctgcaaaatgaagatggatccttttcaggggatatgtggggtgaagttgatacgcggttctcatatattgctatttgttgtctatcaatattacattgcttggataaaatcaatgtggagaaggcagtgaagtacattataagttgcaaaaatatggatggtggttttggttgcactcctggtggggaatctcatgctggtcaaattttctgttgtgtgggggcccttgccataacagggtcactagatcttgttgacaaagacctacttggttggtggttatgcgagcgtcaggttaaatctggaggtctgaatgggcgtcctgagaaacttcctgatgtctgctactcatggtgggttctttctagcctgatcatgattgatagggttcattggatcagtaaggagaagcttataaagttcatcttagactgccaggacacagaaaacggtggaatttcagacaggccagatgatgccgtggatgtctttcatacattcttcggggtggctggactttcacttcttgaatatccagggctgaaaccggtagatccagcgtatgctttacctgttgatgttgtaaatagaattttctttactaaagaaggacttaagtag

SEQ ID NO: 3492 - DNA, 573 bp, Glycine Max
atgggagataacaatgtcaacctcccacccgggtttcgcttctaccccacagatgaagagcttgttgttcatttccttcaaagaaaggcaaatcttcttccttgccatccagatgtcatccctgatcttgaactctacccttatgatccttgggaacttcatggtagagctttggcagagggaaagcaatggtactactacagcagaaggacacaaaatagggtcactagcaatggctattggatgccaatgggaatggaagagccagtgatttcaaactctagcaacaagagagttggcatgaagaaatattatgtgttccatttgggagaagcccctgatggcaacacaaccaattggataatgcaagagtatcgtctattagattctgcttcctctagcatatcatccagaagaagatcacaacctaaaccggaccatagtaaatgggtgatatgtcgagtttatgaacgggataacgatgaagatgatggtgatggaacagagctctcttgtttggatgaagttttcttgtcattggatgatcttgacgaaataagtttgccaaattag

SEQ ID NO: 3493 - DNA, 867 bp, Glycine Max; identical to SEQ ID NO: 458

SEQ ID NO: 3494 - DNA, 480 bp, Glycine Max
atgggagatttggagaagaagcaagagagggtgatggaggaagaagataaagagaggttggtggagggtgtggcggttttggactttgatatgctttgctccactgtggctttgcgagctgcacatggcaaatgggggaagctgggaggtggtgagtttggtggtgttctgaggatgtgggagggtgaagttcttgattgttttgatgatcatcgaatagctctcgaatccacatgttgtccttgctaccgatttgggaaaaacatgaagagagctgatttcggttcttgctacattcagggagcaatttattttcttcttgctattggtgcctttcttaacttcattgcctttgctgtcacgagacgtcactgttatctatacctgattgttgcctttggagcatatttaggattcttccggacacgtataagaaagaaattcaacatcatagtgggtgttttctgtaattgtttatga

SEQ ID NO: 3495 - DNA, 1233 bp, Glycine Max; identical to SEQ ID NO: 459

SEQ ID NO: 3496 - DNA, 150 bp, Glycine Max
atgggaggcatatcagacaacaaatcctcaaagtctttgaaggacacgttcatgagtagcatggaagatgcaacactattctttttaccattagtggtggtgtgtggcttggcactgacaccaccatttgcaattcctcttttgttgtaa

SEQ ID NO: 3497 - DNA, 2562 bp, Glycine Max
atgggaggttccactaaccccctatctctcttccttctctgcttcaccacttttctcactctctttgaagtttcaatctccacagacaccttaacaagttcacaatccctccgaacaaaccaaaccctcctctccccaaacgcgatttttgaactgggttttttttcctacaccaattccacctggtacttgggcatttggtacaaaaccatccacgacagagatagaacagtggtgtgggtcgcaaaccgagacatcccacttcaaacctccctcggattcctcaaaataaacgaccaaggaaacctcgtcatcataaaccaatcccagaagcccatatggtcctcaaatcaaaccacaacaacaccctccaatctaattcttcagcttttcgattcgggaaacctggttctcaaagaaccaaacgagaatgacccaaagaaaattctctggcagagcttcgattacccaacagacaccttgttaccgggcatgaaactaggttggaacttcgacacaggcatagaaaagcacataacctcgtggagtgccacgaacgaagacccttcaagcggggatttttccttcaagctcgatccacgtggccttccggaaatattcctctggaacaagaaccagagaatctaccgtagcggcccttggaacggcgagagattcagcggggtgcccgagatgcaacccaacacagattccatcaaattcacgttctttgtggaccaacacgaagcttactacactttctcaattgtgaacgtttctttgttttctagactctctgtgaactcaattggggaactccaacgcctcacgtggatccaaagcacacaggtgtggaacaaattctggtatgctccaaaggaccaatgcgacaactacaaagagtgcggggcgtacggggtgtgtgacacgaacgcgtcaccggtgtgtcagtgtatcaaagggttccggccgaggaacccgcaggcgtggaatctgcgagacgggtctgatgggtgtgtgaggaacacggaattgaaatgtgggagtgacgggtttctgcgaatgcagaatgtgaagttgcctgaaacaacgttggtgtttgtgaacaggagcatggggattgtggagtgtggagaattgtgtaagaagaattgttcttgcagtggttatgcgaatgttgagatagtgaatggagggagtgggtgtgtgatgtgggttggggagcttttggatgtgaggaaatacccctcgggagggcaagatctttatgtcagattggctgcttctgatgtagatgacatagggattgaaggtggttctcacaagacaagtgatacaattaaggctgttggcattatagttggcgttgcagcttttatactattggcattggccatctttatcttgtggaagaagaggaaattgcagtgtatattgaaatggaagacagataaaagaggtttttcagaaagaagtcaggatttgttaatgaatgagggagtgttttcaagtaacagagaacagacaggtgaaagtaacatggatgacctagagttaccattgtttgattttaacacaataacaatggctacaaacaacttctctgatgaaaacaaacttggacaaggaggctttggtattgtttacaaaggcaggttgatggaaggtcagaacattgctgtgaagagattatcaaaaaattccgggcaaggaattgacgagtttaagaacgaggtcaagttaattgtcaagcttcaacatcgaaatcttgttcggcttcttggttgcagcattcagatggatgagaagatgctagtgtatgagtacatggaaaatagaagccttgatgccattttgtttgacaaaacaaaaagatcctcactggattggcaaaggcgattcaacattatatgtggaattgctagagggctcctttatttgcaccaagattccagatttaggatcatccatagggatctcaaggcaagcaacattctacttgacaaagagatgaacccaaagatatcagactttgggatggctagaatttttggcaccgatcagacagaagcaaataccatgagagttgttggaacatatggttacatgtcccctgaatacgctatggatgggatcttctcagtaaaatctgatgtttttagttttggggttcttgtgctggagatcataagtggaaaaaagaacagaggattctattccgcgaacaaagaattgaatcttctagggcatgcgtggaagctgtggaaagaagaaaatgctttggaactgattgatccgtcgatcgacaattcatattcagaatctgaagttcttagatgcatacaagtcggtctcttatgcgtgcaagagcgtgcggaagataggccaacaatggcttctgtggtcttgatgctgagtagtgacactgcatcaatgtcacaacccaaaaaccctggattttgtctaggaaggaatcctatggaaactgattcttcttcaagtaaacaagaagaatcatgcactgtgaaccaagtcactgtcacaatgctagatgccaggtag

SEQ ID NO: 3498 - DNA, 363 bp, Glycine Max; identical to SEQ ID NO: 460

SEQ ID NO: 3499 - DNA, 462 bp, Glycine Max; identical to SEQ ID NO: 461

SEQ ID NO: 3500 - DNA, 462 bp, Glycine Max; identical to SEQ ID NO: 461

SEQ ID NO: 3501 - DNA, 462 bp, Glycine Max; identical to SEQ ID NO: 461

SEQ ID NO: 3502 - DNA, 6327 bp, Glycine Max; identical to SEQ ID NO: 464

SEQ ID NO: 3503 - DNA, 1353 bp, Glycine Max; identical to SEQ ID NO: 465

SEQ ID NO: 3504 - DNA, 999 bp, Glycine Max
atgggcactcagagaagcaaacccagttgtaccatcgttgcgatctttctagcattttgttgttttgtttcttcttcgaaagcaaagcttgagagtctccaacatgcgcccaaagctgatgggtctctaagcttcttggtggttggagactggggtagaaaaggtgcttataaccaatctcttgtcgcttttcagatgggtgtaataggagagaaattggacgttgattttgtgatctcaacgggggataacttctacgacaatggattaaccggagtgtttgatccatccttcgaagaatcattcaccaaaatctacacggcacctagcttgcagaagaagtggtacaacgttttgggaaatcatgactacaggggaaatgccaaggcacaaataagccatgtccttagatacagagacaatagatgggtgtgcttcagatcatataccctcaattcagaaaatgtagacttcttttttgtagacacaactccttttgttgataaatacttcattgaggataaaggccataactacgattggagaggcatactacccaggaagcgttatatttctaaccttctcaaggacgtggatttggcactaagacaatcaacagcaacctggaaggtagtgattggccatcatacaatcaaaagcattgggcatcatggagacacccaagaacttttaatacattttctcccacttcttaaggcaaataatgttgatttgtacataaacggacacgatcactgcttggaacatataagtagccttgacagttcagttcaatttttgacaagtggtggtggatcgaaggcatggagaggtgacacgaaacagagcgaaggagatgagatgaagttttactacgacggccaaggcttcatgtctgtgcatatttctcaaactcagcttcgaatttctttctttgatgtcttcggcaatgccatccacaaatggaacacctgcaagtttgactcctgtgacatgtaa

SEQ ID NO: 3505 - DNA, 768 bp, Glycine Max
atgggcactcagagaagcaaacccagttgtaccatcgttgcgatctttctagcattttgttgttttgtttcttcttcgaaagcaaagcttgagagtctccaacatgcgcccaaagctgatgggtctctaagcttcttggtggttggagactggggtagaaaaggtgcttataaccaatctcttgtcgcttttcagatgggtgtaataggagagaaattggacgttgattttgtgatctcaacgggggataacttctacgacaatggattaaccggagtgtttgatccatccttcgaagaatcattcaccaaaatctacacggcacctagcttgcagaagaagtggtacaacgttttgggaaatcatgactacaggggaaatgccaaggcacaaataagccatgtccttagatacagagacaatagatgggtgtgcttcagatcatataccctcaattcagaaaatgtagacttcttttttgtagacacaactccttttgttgataaatacttcattgaggataaaggccataactacgattggagaggcatactacccaggaagcgttatatttctaaccttctcaaggacgtggatttggcactaagacaatcaacagcaacctggaaggtagtgattggccatcatacaatcaaaagcattgggcatcatggagacacccaagaacttttaatacattttctcccacttcttaagttcagttcaatttttgacaagtggtggtggatcgaaggcatggagaggtga

SEQ ID NO: 3506 - DNA, 679 bp, Glycine Max
atgggccaccgttgctgcagcaagcagaagatcaaaagagggttatggtctcctgaagaagatgagaaacttcttagatatatcaacacacatggacataaaagttggagttcagtgccaaaatttgcaggcatacatttgtctcgcttgcaaagatgtgggaagagttgcaggttgagatggattaattatctgcggccagatctgaagaggggttccttcactgctgaagaagagcagatcataattgacatccatagaattcttggaaacagatgggcacaaatagccaagcacctaccaggaagaacagacaatgaggtcaagaatttctggaactcatgcataaaaaagaagctcatttcacaaggcttagatccacaaacccacactctcctgtcttctcataggagaagctcagcatatgatggagaacccctccaacatttgccttatgaactattaatggaaaacgccaccaacatttgttcacctacatacatgaacccctcagcagttgaattgtgtaacgatgacaacaatgtgaattgggtttcaagacttaatgttcatgatttcagtgctcaaacactggaagaaggagcacaaagttctaactttgatcttgggtttttggagagtgtacttacctctgaattcatctctcatgatctcaatt

SEQ ID NO: 3507 - DNA, 162 bp, Glycine Max; identical to SEQ ID NO: 466

SEQ ID NO: 3508 - DNA, 1437 bp, Glycine Max; identical to SEQ ID NO: 467

SEQ ID NO: 3509 - DNA, 1089 bp, Glycine Max
atgggcttctggaagttcttcagtggagtcatcaacttagcctcatacccggttctatgcatagattatctcaaactggtgatcccaattttatcttctggcttccctcgttttgtgtctatttctctctccacttgtgtcttgtcctttttgaactattctggtttggctatagtgggttatactgcagttgttcttggtgttgtttcacttttgccttttgtgttgttgtctttgttttccttgcccaaaattgaccccagcaaatggctaagttttggtcaagagggtgtggagaaggattggacactgtacttcaacaccatcttttggaacttgaacttttgggacagtgctagtactctagctggtgaagttgaggagccacataagactttcccaaaggccttgttatctgcagggttgcttacttgtttgggatacataattcccttgttggctaccactggggctatgccacttgatcaacaaagttgggttggtgggtattttgcacatgttgctggggtcattgctgggaattggttgaaaatttggatggaaattggtgctgttttgtcaataattgggttgtttgaagcccaactaagcagtgctgcatatcagcttcttggtatggctgatttgggattcataccaagaatttttggtgaaaggtctaagtggtttaacactccttggatggccattttgatctcaacagttgtagcactcggcatgagtttcttgaccttcacagagatcatatctactgtgaatttcttgtacagtttggggatgcttttggagtttgcagctttcctaaggttgaggaggaaattccctgctttgaaaaggccatttcaggttccattggggttctttggtttaatcataatgtgcttggtaccatcaattcttttggtgtatgtgatgactgttgcttccaaaattgtgtatgtggctagtgccttcttgacctttcttgggattgctttatattatttcatgaatctttctaagtctaggaagtggcttgaattcagccgtgtgggagataaattgggtgaagatgattatgttttgtag

SEQ ID NO: 3510 - DNA, 1278 bp, Glycine Max
atggggaaagaggaggaagagatgaggggtgagattgaggaacgactgattaatgaagagtacaagatatggaagaagaacagtcctttcttgtatgatctggtcattacgcatgccctcgagtggccttccctcactgtggagtggcttcctgaccgccatgaaccacctggcaaagactactccctccagaaggtcatcttgggcacccacacttctgaaaatgagcccaattacctcatgctggcgcaggtccaactccctcttgatgatgctgagaatgatgcccgccactatgatgatgaccgccctgacattggtggctttggctgtgccaatggcaaggtccagatcatccagcagatcaaccatgagggtgaggttaacagggctcgctacatgccccagaaccccttcatcattgccaccaagaccgttagtgctgaggtttatgtcttcgattatagcaagcatccctctaagccccctcttgatggtgcctgtaaccctgatttaaggcttaggggtcataacactgaaggctatggtttgtcctggagtaagttcaagcagggccacttgcttagtggttctgatgatgctcagatttgcttgtgggatattaatggcactcccaagaataagagcctagaggcaatgcagatttttaaggttcatgaaggtgtcgtggaagatgtggcttggcatttgaggcatgagtacttgtttggttctgttggtgatgatcaatacttacttatatgggaccttcgaacgcccgctgccagcaagcctgtccaatctgttgttgctcatcaaagtgaggttaactgcttggctttcaatccctttaacgaatgggttgttgctactggttctacagataaaactgtgaagttgtttgatctgcggaagatcaatactccactgcacatctttgattctcacaaggaggaggttttccaggttggctggaatccaaagaatgagactatcttggcttcttgttgtctgggtaggagactcatggtgtgggatcttagcaggattgatgaagagcagtcaccagaagatgccgaagatggtccaccagaattgctctttattcatggaggtcatacaagcaaaatatctgacttttcctggaatccatgtgaagattgggttgttgctagtgtcgccgaagacaacatacttcaaatatggcagatggcagagaacatataccacgacgaagatgatctgccagaagagtcaacgaaggcagcggcatcctaa

SEQ ID NO: 3511 - DNA, 435 bp, Glycine Max; identical to SEQ ID NO: 468

SEQ ID NO: 3512 - DNA, 561 bp, Glycine Max
atggggaagaagaaggtggagataaagcgaatcgagaacaaaagcactcggcagataacattctccaagaggcgcaatggattgatgaagaaagctcgcgagctatccattctctgcgatgcgaaggtggcgctgctcatcttctccagcaccggaaagctctacgagctctgcaacggtgacagtttggccgaggtcgtgcagcaatattgggatcatttaggagcgagcggtactgacacaaagtcgcaggaactatgctttgaaattgcagatatctggtctggttcagcgttttctcaaatgatcaaaaggcacttcggtgtttctgaacttgagcatctgagtgtgtctgaccttatggaactagagaaactgactcatgctgctctttcgcgaatcagatcagcaaagatgcgattgatgatggaatctgtagtgaatcttaagaaaaagattgaggcactagaaaaaactaatgacgtcaataacgtggtgacacggtctattgactgtgatcaaacagatggggtgacgcataatctgttcccaggtctctaa

SEQ ID NO: 3513 - DNA, 216 bp, Glycine Max
atggggaagctcgtcgagattcttgaccaaggggtcaggattgctgcaaggtttcactctaattgcccccaaacgggccgcaagtactaccaccctccatccctctccgacaaccacggccaccactaccacgctggtgccaccaccaccagcgccggcggagtcaaagaggccgtggcggctaggagcattgacataattctttattctgtttga

SEQ ID NO: 3514 - DNA, 1221 bp, Glycine Max
atggggaaggttgtgttgttgtttctttgcatggtattggtggtggtgcctttggcttgtactgattcaattcagaagcttgaggttcagaagcacttgaagaacttgaataggcctcctgttaggtccatcaagagtcctgatggagatgttattgattgcatccatgttacacaccagccagcttttgatcaccctgacctcaaaaatcacaagattcagatgaaaccaaatttccatccagaagggcatccttttggagaaagcaaagtctcttcaaattcaaagcctattactcagctgtggcaccaaaatgggaggtgccctgaaggaacaattccggtccgaaggacgaaaaaggatgacatattaagaacaagctctgttcagcattttggaaagaagaagcaaagtagcttccctcagccaaaacctgcaaaacctctacctgacatcatcagtcagagtggccaccagcatgccatagtgtatgtggagggagataagtattatggagccaaggcaaccataaacgtttgggacccaaaaattcaacaacccaatgaatttagcctttctcaaatgtggattttgggtggctcttttggtcaagatctcaacagcattgaagcaggttggcaggtcagccctgatttgtatggagacaacaacactagactcttcacttattggacaagtgatgcatatcaagctactggttgttataatctcctttgctctggctttattcaaattaacagtgatatagccctgggagcaagcatctccccactttctaagtatagctcttcccaatatgatatcagcatcctggtctggaaggaccccaaagagggtaactggtggatgcagtttggtaatgatcatgttatgggatactggccggctcctctattctcgtacctctccgacagtgcgtcaatgattgagtgggggggagaggtcgtgaactccgagtccgacggccaacacacctcgactcaaatggggagtggccatttccctgaggaaggttttggcaaggctagttacttcaagaacattcagattgttgatggtgacaacaagcttagagctccaaaagaccttggcacttacactgagcaagatagctgctacaatgttcaaactggtagtgctggagattggggtaactacttctactatggtggtcctggtagaaatccaaattgcccttga

SEQ ID NO: 3515 - DNA, 813 bp, Glycine Max; identical to SEQ ID NO: 469

SEQ ID NO: 3516 - DNA, 816 bp, Glycine Max; identical to SEQ ID NO: 470

SEQ ID NO: 3517 - DNA, 1446 bp, Glycine Max
atggggaatatactgaatctaaacaattcaaagactagacggaatgattcccatggggtcttgcaaggtgaatcctgcaagagacagaggttgtcaccaaactcttgtgaggacaacccaagactgattccgtcccttcctgatgagatatcaatacagattctagctagagttcctcggatttattatttgaatctgaagttagtttgtcgtgcttggaaggaaacctttgttagttctgaactattttgtgtgagaaaagagcttggaagcatggaggaatggctctacattttgacaaaggtcaacgatgataagcttttatggtatgccttggaccctctttccagaagatggcaaaagttgccgccaatgccaaaagttgggtttgaagatgaaacaaagaaaggtttgatttcctttccccttcggatgtggagcatgatgggttcaagtattcgaattgttgatgtcataatgagctggcttgggaggagagatgccctggactggatgcctttttgtggttgctccataggagctgttgatggttgcatctatgcattaggaggattttcaagagcttcagcaatgaaatatgtttggcagtatgatcccattaaaaactcttgggctgaggctagtccaatgtcagttggcagagcctattgcaagacaggtatattaaataataagctttatgttgttggaggggttactaggggtcgtggtggactaagccctctgcaatctgcagaagtatatgaccctcatacaggcatgtggtccctgttacctagcatgccttttgcaagagctcaagtgttgccaactgcttttttggctgacttactcaagcctattgccacaggaatggcttcatacaaaggaaggttatttgttcctcagagtttgtattgctggccattttttgttgatgttgggggtgaagtttatgatccaaatttaaattcatggcttgaaatgccaattggtatgggtgaaggctggcctgcaaggcaagctggaacgaaattgagtgttacggtcgatgatgatctatatgcacttgatccttcaaattctcttgacagtgcaaagatcaaggtatatgattatgaaggtgatacttggaaagttgcagcaggagatgttcctattcatgatttcaccgaatcggaatctccttatctcttggctggtttacttggaaaacttcatgtaataactaaagatgctaatcacaacattacagtgttgcaggctgacatgcaaaatgaacatgctgagtcagctttctctcaatcaatattgtcatcaccagataactcgatcagtgaagatgctgaatcttctgcagaaacacagggagaattttggaaggttcttgcaactaggagtggtagatctgctgaactagttaactgtcaatcccttaaaatatga

SEQ ID NO: 3518 - DNA, 1809 bp, Glycine Max; identical to SEQ ID NO: 471

SEQ ID NO: 3519 - DNA, 186 bp, Glycine Max
atggggagaggaaagatcgtgattcgaaggattgacaattccactagccggcaagtgacgttttccaagagaagaaatgggttagtgaagaaagctagagagctatctattctgtgtgatgcagaagttggattgattgtgttctccagcactggcaagctttatgactatgcaagcaccaggtaa

SEQ ID NO: 3520 - DNA, 216 bp, Glycine Max
atggggagaggaaagattcccattcgaagaatcgaaaattcgacgaaccgacaagtgactttctgtaagagaagaaatgggttgctgaagaaaactagagaactatccattctctgtgatgcagaagttggagtgatagtgttttccagcactggcaagctttatgaatattcaaacaccaggtcaggagttgattgtggctcaaggctaagctag

SEQ ID NO: 3521 - DNA, 1413 bp, Glycine Max
atggggaggaggatgatgcaatggaacaccatcaccaaagcttcaattctcatcaccatcaccctccacttgattctccccgtggccgttaacagcatgaggctcgaactggtgcacaggcaccacgagcgcttctccggcggcggcggtgacgtggatcaggtcgaagcgaagaagaaaaggcttggaaacaacgacgacgacggaggtggaaatgccgatgcgcgcggggcgcgacgatgccctcggcgagtacttcaccgaggtcaaggtcgggagccccgggcaacggttctggctcgccgcggacaccggcagcgagttcacgtggttcaactgcgtaatgcggaatgctacaacaacggcaacaaccaagaagaccaggaagaacaaaaccaaaaagaaacatcatcatcacagcaagaggaacaggacgaggacgacgaggagaacaaagaagaagaaggccaagagtctaagtcctttcaagctgtcacgtgtgcgtcgcagaagtgcaagattgatctcagtcagcttttctcgctcagtctttgtcccaagccttctgatccttgcttgtatgacatcagctatgctgatggatcatctgcaaagggattctttggcactgacactatcacagtagacctcaaaaatggaaaggaaggaaaattgaataatctcacaattgggtgcacaaaatccatggaaaatggggtaaacttcaatgaagacactggaggtatattggggctaggctttgccaaggactcattcattgataaagcagcttatgaatatggtgccaagttctcctattgtttagttgaccatttaagccacagaaacgtttcaagttatctaaccattggtggccaccacaatgccaaattgttgggtgaaatcaaaagaacagaactcattttgttccctccattctatggtgtgaatgtggtaggcatctcaattgggggccaaatgctgaaaatcccacctcaggtttgggatttcaattctcaaggaggcaccttaattgactcaggcacaaccttgactgcactacttgttccagcctatgagcctgtttttgaggccttgatcaagtctttaacaaaagtcaagagggtcactggtgaagactttggagcattggatttttgctttgatgctgaggggtttgatgatagtgtagtgccaagattagtgttccattttgcagggggagcaaggtttgagccaccagtgaagagctacatcattgatgtggcacccctagtgaagtgcattggaattgttccaatagatgggattggtggtgcatctgtcataggcaatattatgcaacaaaatcatctgtgggagtttgacttgtcaacaaacactatagggtttgccccttctatctgcacttaa

SEQ ID NO: 3522 - DNA, 1194 bp, Glycine Max; identical to SEQ ID NO: 472

SEQ ID NO: 3523 - DNA, 1872 bp, Glycine Max
atggggatttccttctcatgtccatttgccaagtacaatgatgtggaggatggcttagactccgttgttgtaaaatccatcaactttggcaatgatgaaatcaaaactccaatgcgatcggtcagtttcaagaatgatgatttagaacccaccatccttaaatctctaggttctggaaagatgacagtagagacatctgtgagcttcaaaagaaaggacattgataacattatctcaaccaacactttgactagcaagaagagcaaagaaatggatgatctgccttttaagtcagagttatacaagagctttcgcacgagaagaaagctagcagattgtgcaattcttgttgaacaaagctggtggaaactcttggattttgctgaactcaagcgcagctccatatctttctttgagattgagaaacatgaaactgctgtttctcgttggtccagagctagaactagagctgctaaggttggaaaaggtttattaaaagacgataaagctcaaaaacttgctttacagcactggcttgaagcgattgacccacgccatcgctatggacataatctacacttctattacgataggtggcttcagtgtcagagcagagaacccttcttctactggctagatataggagaaggaaaggaagtaaatcttgagaaatgccctcgttccaaacttcaacagcaatgtattaaatatcttggtccgatggaaaggctggcttatgaagttgttgtggaggacggaaagttcttctacaagcagacaggagagctccttaacactggagaagatgcacatgccaagtggatttttgtccttagcacatctaagacattgtatgttggcaagaagacaaaaggttcatttcagcattctagcttcttggctggaggagctacatcttctgctgggagactagtggttcaaaatggtgtcttgaaggctgtttggcctcacagtggtcattatcgtccgacagaagaaaattttaaggaatttatttcattccttcaggagaacaatgtgagccttttagacgtcaagatggatccagttgatgaggttgatgacttactttctctgagaagtagtggtcatcttagaagccactcatctgaagaggacttcactgagaacatgaatggcctggagattgaagagaccactactgaagactcagttgcagtagagaaggccaatttgatcgaaaccgagaggccttctgcattgatggcacctagcccaaggcaatttcaaattcttggaagagaactgggcaatcttgaaataccaaaaaggggtaatgtgtttgaaggactagaaaatgagatagaaggtgttgaacaaagttgtgtgagtttccctatggaatcacacacaggtagtcaagaaacaacactagcatttgtaccagaactagaccataccatttcagagaaaaaaaacttatctgatgacaatgatgtagaaaccattccacaagagtccatactcaaaagaatcaactcacataaagaaatgaaatcatatcaactggggaagcagttgtcttgcaaatggacaaccggagcgggaccgcgcattggctgtgtgagggactacccttgtgagcttcagttccgagcattggagcaagttaatctgtctccaaaaagtggatcccgctctaaatcatcttttgctcttagaagcaccattttgttgagctctagtctttcaaatgtggcaagtttatgtggggacttaacaatagaaccacttcacatgccccaaagaggtgagtcctatagttcaagatcagaatgctcccctttgatcagaggaacatcagtgataccagttattcatagttcatga

SEQ ID NO: 3524 - DNA, 1329 bp, Glycine Max
atggggcacgaagtttttttttttttaatgctgagaaaggattgtttggagttgtatcagatagaaggccagctgacatctgtaaagaaggcactcattgctgtctctcatcggcttcaagattgtcctcctcctgatagaacaaagatgacaggaagcagacattatgaagtggttcagtctgagacattttcagttccacttgagtctttaactaatctgcatatagatcatcatctgcaaaggagctctacattatccactttatccaataggtctaatggcaatgcctctggagctcataaattatcagctgaagttaatagagtctcagccctggatccaaaagcatatcagcaggaagttacctttagaattatttgttccaatgatagggttggtgccgtaattggaaaaggtggcagtattgtaagagctcttcagaacgaatcaggggctattataagtgttggtccttcattagttgagtgcgaggatcgactagttactattactgcttcagagaatcctgaatcaacatattcccctgcacagaaggctgttgtgcttgttttctccaagtctgttgaggctggtgttgagaaggggctagagttgggatcaaaaaaggagccatatgttactgcacgacttgtagtcccatcaaaccaagtgggttgtttgttagggaaaggaggggcaatagtctcagaaatgcggaaagccacaggggctaacataagagtaattgggaatgatcaggttccaatgtgtgtatcagataatgaccaattggtacagatatcaggagtgttttcaaatgttcaagctgcaatacataatgcaactggtagactgcgagatcatctttttgtcagtacgcaaaacagtggtggagcaaggagcctttcctctgttctagctggaggccaaccaactcttgctatttctcatagtctcaatagacattctttgccaggattacaggcaccacagacagtggctgggataaattccagaggcaccaatggtgttagtcggggattgatttctcgaaaaggtggcttagaacttatcagtgggagtaaaactgccattgttactaatacaactgtgcaaattgtggttcctgatgatgttattggctctgtatatggggaaaatggtagcaatctggctcgcctgagacaaatatcaggggctaaggttattgtccacgaacctcgtcctggaacaagtgataggactattatcatatccggtacacccgatgaaactcgagcagcacagagccttctccaagcatttattcttgctggatcatcgtga

SEQ ID NO: 3525 - DNA, 1086 bp, Glycine Max
atggggcacgaagtttttttttttttaatgctgagaaaggattgtttggagttgtatcagatagaaggccagctgacatctgtaaagaaggcactcattgctgtctctcatcggcttcaagattgtcctcctcctgatagaacaaagatgacaggaagcagacattatgaagtggttcagtctgagacattttcagttccacttgagtctttaactaatctgcatatagatcatcatctgcaaaggagctctacattatccactttatccaataggtctaatggcaatgcctctggagctcataaattatcagctgaagttaatagagtctcagccctggatccaaaagcatatcagcaggaagttacctttagaattatttgttccaatgatagggttggtgccgtaattggaaaaggtggcagtattgtaagagctcttcagaacgaatcaggggctattataagtgttggtccttcattagttgagtgcgaggatcgactagttactattactgcttcagagaatcctgaatcaacatattcccctgcacagaaggctgttgtgcttgttttctccaagtctgttgaggctggtgttgagaaggggctagagttgggatcaaaaaaggagccatatgttactgcacgacttgtagtcccatcaaaccaagtgggttgtttgttagggaaaggaggggcaatagtctcagaaatgcggaaagccacaggggctaacataagagtaattgggaatgatcaggttccaatgtgtgtatcagataatgaccaattggtacagatatcaggagtgttttcaaatgttcaagctgcaatacataatgcaactggtagactgcgagatcatctttttgtcagtacgcaaaacagtggtggagcaaggagcctttcctctgttctagctggaggccaaccaactcttgctatttctcatagtctcaatagacattctttgccaggattacaggcaccacaggtatactgctttctctctgcttgctggttttcctttccaagttttccctatctagtaattaaatttggttgcagacagtggctgggataa

SEQ ID NO: 3526 - DNA, 954 bp, Glycine Max
atggggctgcagcttgttttcattggtaccatagccctgtgtttggttgtttcctcggcagtgcttgagcggtttgaacaagcacttaaacaagatgggtcacttagcttcttggtcattggagattggggaagaaaaggagcttacaaccaatccaaagttgcattccagatgggagttattggacaacaattggacatcgattttgtgatttccaccggcgacaatttttatgacagtggcttgacaggcatagatgatccagactttgatactgcttctagcttgcaaaagcaatggtacagtgttttgggaaaccacgactataggggtaatgttgaggcacagctgagtcctgtcctcacaaatcttgacaagagatggctttgcctgagatcttttattgtaaatgcagaagttgcagagtttttctttgtagatactactccgtttgtggacaaatacttcatagaacctaaggaccatgtttatgattggagtggcatattgccccggaaacaatacatttccaacctactcaaggatgtggatttagctttacaacaatcaaatgcaaaatggaagattgtggtgggtcaccatacaattagaagtgccggcgtgcacggtaatacggatgagcttgtaaagcagcttctcccaattcttgaggcaaacaacattgatctttacataaatggacacgatcactgcctacaacacataagcagttttgacagtgcaattcaatttttgacttgcgggggagggtcaaaggcgtggaggggtgttgtgaactggtggaagccagaagagatgaagttctactacgatggccaaggagtcatgtctgtgaaggtcactgaaactgaaattgacatagtattctatgatgtctatggccatgttctacacaaatggaacacatccaaacagcttcacgcaagttggtga

SEQ ID NO: 3527 - DNA, 969 bp, Glycine Max
atggggctgcagcttgttttcattggtaccatagccctgtgtttggttgtttcctcggcagtgcttgagcggtttgaacaagcacttaaacaagatgggtcacttagcttcttggtcattggagattggggaagaaaaggagcttacaaccaatccaaagttgcattccagatgggagttattggacaacaattggacatcgattttgtgatttccaccggcgacaatttttatgacagtggcttgacaggcatagatgatccagactttgatactgcttctagcttgcaaaagcaatggtacagtgttttgggaaaccacgactataggggtaatgttgaggcacagctgagtcctgtcctcacaaatcttgacaagagatggctttgcctgagatcttttatttgcctttttacattctttgtttcagaagttgcagagtttttctttgtagatactactccgtttgtggacaaatacttcatagaacctaaggaccatgtttatgattggagtggcatattgccccggaaacaatacatttccaacctactcaaggatgtggatttagctttacaacaatcaaatgcaaaatggaagattgtggtgggtcaccatacaattagaagtgccggcgtgcacggtaatacggatgagcttgtaaagcagcttctcccaattcttgaggcaaacaacattgatctttacataaatggacacgatcactgcctacaacacataagcagttttgacagtgcaattcaatttttgacttgcgggggagggtcaaaggcgtggaggggtgttgtgaactggtggaagccagaagagatgaagttctactacgatggccaaggagtcatgtctgtgaaggtcactgaaactgaaattgacatagtattctatgatgtctatggccatgttctacacaaatggaacacatccaaacagcttcacgcaagttggtga

SEQ ID NO: 3528 - DNA, 660 bp, Glycine Max
atgggggcagggaaaggggctgtttggttctccaacgcggtggcgttagtagctatcgcggtggtagcttgccatgcccaaccttcggcgacgttcaagtgcagcagcgcgaacaaacccacgtgtcgtcccctgattagctactctaacccgaacaccaccaccctcggcgacattcaaaagctcttcaacgtaaaacacatcatggacatcgtgggagcgaacaacgccacaaaaaaaatatacggtgggccccaacgaggttgtgaaggttcctttcccgtgcaggtgcagcaacaacacgggatatcgtcacgacgacgtttgcggaaatatttggtacaatccaatccgagcagcgtggacctttgtctaatagccaaattacaatgtgagccatcccaactcaaatcaaccaactggtcttcttggccctctctggagtgttcaagcaacgtcattccctccacagattcctgcaatcgcacaacctgcgcctataccggttattataccttccgcaatatctcagcagaagttgtaacagagaacaccacttgtgctgtgccaccgagtggttcaggaggatcaactggttctgattcaggagctaaaaaaaaataccctacacttctgcagccattgtttttaatagattag

SEQ ID NO: 3529 - DNA, 813 bp, Glycine Max
atggggtgcgtgtcttcgaatttgctgaaccaagacgaagacttcagcacccaacttggctcctccgcactgggccaccacatcgtgtccctcacctccaccacctacggcctcctcaccctcgaccctccttccacgcctccttcccgctttacccttggatctctcttcccctccgaaccagaggtcatcaactcatgggagctcatgtccggcctcgacaccgacagcttccgcttctctcctttacctttacccaaacccaaagaaaaccgcctcactcccccaaccggttccaaactcttattaaccccaactctggcggaccggttcgagaaaatatgcccccccaacggtgagaagcgcgtggtgatctatacgacgtcgttgcggggcgtgcggacgactttcgaggcctgcaacgcggttcgcgccgccttggagggattcggggtggtgatctgcgagcgtgacgtgtccatgcacagcggcttcagagaggagctcaggactctattgaaggggaagcaggtgatggtgcctccgagagtgttcgtgaaggggctctacatcggtggcgccgatgaaatgcttaaggtcgccgaagagggtctccttggagacttgcttgatggcttgcctagaaagaaggttggggctgtttgtgtgggttgtggggacttgaggttcttgccttgcttcaactgcaatgggagctgtaagactcttgttaaggaacaggggaggacggttgtggttaagtgtacccattgtaacgaaaatggcttagtcttgtgcccgctttgtacttga

SEQ ID NO: 3530 - DNA, 282 bp, Glycine Max; identical to SEQ ID NO: 473

SEQ ID NO: 3531 - DNA, 1251 bp, Glycine Max
atggggtttcagaagataagggtgggcaaccccatcgtcgaaatggatggggatgaaatgacccgagtgatttggaaactgataaaagataagcttattttcccttatttggagctggatattaagtattttgaccttggccttcctcatcgcgatgccactaatgatagagttactattgaaagcgctgaagctacactcaagtataatgtagctatcaaatgtgctactataactccagatgaagctcgtgtcaaggagtttaacttaaaacaaatgtggagaagtccaaatgggacgatccgaaacattttaaatggtacagtttttagagagccaattatctgtaagaacattcctcgtcttgtttcaggatggacaaagccaatatgcattggaagacatgcttttggagaccaatatcgggcaactgatacagttataaaaggcccaggaaagctaaaattggtttttgcacccagtggaaatgaaggcattaaagagctagaggtctataactttactggtgctggaggcatagctttgtccatgtataatactgatgagtccattcgagcttttgctgaggcttcaatgaactttgcttaccagaagaaatggcctctctatcttagcactaaaaataccattttaaagaaatatgatggaagattcaaggacattttccaggaagtttttgacacccaatggaatcacaagttcaaagctgcagggatatggtatgaacaccgtcttatagatgatatggttgcttatgctctcaaaagtgatggaggttatgtatgggcctgcaagaattatgatggtgatgtgcagagtgatttcttagctcaaggatttggttcacttggcttgatgacgtcagtactggtttgcccagatgggaaaaccattgaagcagaggcagcccatggcactgttacccgtcattatcgggttcatcagaagggaggtgaaaccagcacaaacagtattgcttcaatttttgcctggtcgcgaggtcttgcacatagggcaaaattggatggaaatgctagattgttggacttcacagagaaactggaagcagcttgcattggaacagttgaattgggaaagatgacaaaggatcttgcacttcttgttcatggacctaaggtttctagatcccagtatttgaatactgaagagttcattgatgccgtagccgaggagctgcgaacaagattatcttcacaatcgaagctgtaa

SEQ ID NO: 3532 - DNA, 1254 bp, Glycine Max; identical to SEQ ID NO: 474

SEQ ID NO: 3533 - DNA, 897 bp, Glycine Max; identical to SEQ ID NO: 475

SEQ ID NO: 3534 - DNA, 897 bp, Glycine Max; identical to SEQ ID NO: 475

SEQ ID NO: 3535 - DNA, 1005 bp, Glycine Max; identical to SEQ ID NO: 477

SEQ ID NO: 3536 - DNA, 1149 bp, Glycine Max; identical to SEQ ID NO: 478

SEQ ID NO: 3537 - DNA, 984 bp, Glycine Max; identical to SEQ ID NO: 479

SEQ ID NO: 3538 - DNA, 1146 bp, Glycine Max; identical to SEQ ID NO: 480

SEQ ID NO: 3539 - DNA, 1293 bp, Glycine Max
atgggtaattggtggttaggaagaacaacaagggttggttacagttaccgtagtgagtttctgatccgatggatgacgagcagcaagagggtccaagacaggagcaagaagaagagggttcacgacctcgaagtcacaaccgagaaatggaaaatagcctccaaaatcatctacttaatggagcttctcaagcaagagcccgaaatggtcattgccgttcgctccctggagcaccaccgcagacaaatcaacctccccaagccccaccgtgtctccgatttcctccgcaaaacgcccaacctcttcgaactctacaaggaccaaaagggggtgctatggtgcggcatgacctcaaaagccgagaacttgatggaacaacaacaaagggtcatcgaagaacatgccgacaaagtcgccgaacacgtcacgaggtttctcatgatgtcgctggataaaaggcttcccttggagaagattgctcatttcagaagagattttgggttgccgttggattttagagtccattgggtgcatatgtatcctcagcattttagggtggtgaaagcacttgatggggttgagtttttggagcttgtgtcttggaaccctgattgggcaatcactgagttagagaaaaaggtggtgacagagaaaactgcaactaccaataccccagggatgctttcaattccatttcctttgaagttccctgcgaattataagagggtgtatcgttactatggtgaaaagattcagcattttcaggagatgtcttatttgtctccctatgctgatgctcgtggacttaaggctggatcattggagtttgataaaagggctgttgctgttatgcatgaactgcttagtttcaccattgagaagaggttggtgactgatcacctcacacactttcgttgggagctggtgatgccccagaagctgatgaggcttctgctcaagcattgtgggatcttctatgtgtcagagagggggaagaggtttagtgtgttcttgactgaggcttatgagggttctgagctgattgagaaatgccccttggtgctgtggaaggagaaggttttggggcttgtggggtatagagggaggaagaagaagtttgaggtatgcagtgatgatggatctgatgtggaggatcatgatggtttggtttgtgatcagagggattctgaagtgggggacttgcatgtgcagattgagcctcggggtaccttggattatgaggatcctttacttggggatgattctgagatggatgttggagagattacatga

SEQ ID NO: 3540 - DNA, 3504 bp, Glycine Max
atgggtacaactgtggcaacgaatgcacttttagagcgcaagggagaaaggattgcagtgtgtgtgactcgaggctttcgtgatttactccagatagggaaccaggctcgccccagcatatttgaccttactgtgttgaagccatcaaatctctatgaagaagttgtggaggttgaagagagagttcaacttgttcagtctgaggaagaagaagaaaagcagggtggttcttcatctgtggttaagggaatttcaggggagcttgtcaggattgtgaagcctcttaatgaagaagcactgaagccagtactgaaaaacttattggacaaaggaattagttgtttggctgttgttttgatgcactcatacacttatccacaacatgaacaacaggtcaagaagttagctttgagtctgggattcagacatgtttccatatcatctgctttgagtcccatggtccgtgctgttcctcgtggtctaacagctggtgtagatgcttatctgaccccagttattaaagaatacctatcaggattcatctccaaatttgatgagggaattggaaagttgaatgttttgtttatgcaatcagatggaggacttgcacctgagagtaccttctcagggcacaaagcaattttatctggtcctgctggtggagttgttggttactcacaaactctttttgggcttgaaacagataagccactaattgggtttgatatggggggaacatctacagatgtgagtcggtatgcaggtagttatgagcaagtgctggaaacccagattgccggtgccataattcaagcacctcagcttgacataaacactgtagctgctggtggtggttcaaagttgaagttccaatttggtacttttcaagctggaccagaatcagttggagcacaccctggtcccgtatgttaccgaaaaggtggagagttggcaattactgatgctaacctagttctgggatatgttattcctgattatttcccttctatatttggtccaaatgaagatcagcctcttgatttcaagtcaactagaggagaatttgagaagcttgccaggcaaataaatactcaccgaaggaatcaggatccatcttcaaaagacatgacagtggaagagattgcacttggctttgtggatgttgctaatgagacaatgtgtcgtcctataagacagttgactgaaatgaagggccatgagacaaagaaccattcacttgcttgctttggtggtgctggacctcagcatgcttgtgctatagctaggtcgttaggtatgaaagaagtgctcattcacagattttgtgggatcttaagtgcatatggaatggggttggcaaatgttgtggaagaggcacaggaaccttattctgcagtgtatggagttgaatctattgttgaggtctcacaacgagaagctgttttacttagacaggtaaagcagaaattgcaaattcaaggatttaaggaggaaaatatttcaacagagacatatttaaacttgagatatgaaggtacagacactgccatcatggtcaaaagacaagtagctgaagatggaaatttatgtgactatgctactgagtttgtgagattgtttcaacaggaatacggctttaaactccagaataggaatattgttatctgtgatgttagagttcgtggtataggagtcaccaatatattgaggccacaggccatagaacctgcccctggcagtcctatagttgaaggctactataaggtttactttgggaatggttggcaggaaacacctctctataagcttgaaaagctgggctatggtcatatgatgtctgggccagcaatcatcatgaatggcaatagcactgtgattgtagaacccaactgtagagccattataaccaaatacggaaacatcaagattgaaatagagtcccctttaaccagtgttaaaatatcagataaagttgcagatgttgtacagctctccatcttcaatcacagatttatgggtatagctgagcagatgggaaggacactacaaagaacttccatttcaacaaatatcaaagaacggcttgatttttcctgtgctctatttgatcctagtgggggcctagttgcaaatgcacctcatgttcctgtccatctaggagctatgtctagtacagttcagtggcagctcaattactggggtagccatcttcctgatataactgttattacacctgttttcttcaatgggaagttggttttttttgtggcaaatagagggcatcatgcagagatcgggggtactacccctggaagcatgccgcctttttcaaaatccatattggaggaaggagctgccattaaggcatttaagcttgttgaaaaaggtatctttcaagaagaggggatcattaaacttctgcagttcccaagctctgatggtcgaggaaataagatagcaggaactcgcaggattcaagataacttgtcagatctgcgagcgcaagtagcagcaaatcaaagaggaatttctctagttctagagctcattgagcagtatggtcttgaaacagttcaggcttacatgaattatgtacaggtgaatgcagaagcggcagtaagagagatgctgaagtccgttggtcatagaatttcatccaagtcaaatgaactcgtgactattgaagaagaggactacatggatgatggatccattattcatttgaaactgagcattgattctaataaaggagaagcagttttcgattttgctgggacaagttctgaagtttatggtaattggaatgcgcccaaagctgtaacagctgcagctgtcatatactgtgtccgctgtttagtgaacgttgatattcctctcaatcaaggctgtttggctccagtgaagattcttattccagaaggctcatttctctctccaagtgatactgctgctgtagtaggaggtaatgtccttacatctcagaggataactgatgttatattcactgcatttcaggcctgtgcttgttcccagggatgtatgaataattttacatttggggatgatacttttggttattatgaaaccattggaggtggaagtggggctggtcctacctgggatggaaccagtggggtacagtgccacatgacaaatacaagaatgactgatcctgagatatttgagcaaagatatccagtgattctgcacaagtttggacttagagaaaacagtggaggagatggatttcacaaaggtggtgatggtcttctccgagaaatagagtttaggcgcccagtaattgttagcattctttctgagaggcgtgtccatgcaccaagagggctcaagggaggaaaagatggtgctcgtggagctaactaccttgtaaagaaagataaacgaaagatttatctcggtggtaagaatacagtcgaagtgcttccaggggaaattcttcagattttgactcctggcggtggcggatggggttctccattgtga

SEQ ID NO: 3541 - DNA, 1359 bp, Glycine Max
atgggtaccatcgttgaagcagataacacatataccaagatcctaggaagatggccagtcttttattatggcatgggacacatgctcaatgacataactgctgcttgttggttcacatatttattattgttcttgacagatattggactttcaccaaggaatgcagctgttgtgatgctttctggtcaagtggctgatggatttgtcaccatatttgttggtgaactgatagacaggtttggacacttcaagatatggcatggtgctggatctttattggtggcaatttcattttcttctgtttttggtggttgtttaccatgcaaactgtttagttccaattcaggtacttttgaaactttgagttacagcatgtatgcagcaatcttcaatgtgggctgggccgctactcaggtttcacacatgtccatggtgagttgcatcacgctgaactctacaagcagagtggcactggctagctgtcgcaatgcttttaccatggttgccaacctgagcctgtatgcagttgcattgatagtattcagtgtcatcaatggaaaaacacatgatgatgttgaaaatcagtaccgctggattgcatatctgtcaatttttattggatgttgctttgtgggcgtatttcatcttgcaaccaaagagcccagattgaaggtgggtgtacatggaatggttcatgcaaggatttcatgggattactggttcaagagaattctatattatcaggttgctcttgtttatgttcttacaagattggttctcaacgtttcacaggcataccttgctttctttgtcatcaatgacctacaaatggcccaatcagccaaagctttggttcctgctctcatatacatctgcagctttgttgtgtctatagcattacaggagattgcatggactggccgaatgcttaaggcctactactctgctggatgcattctttggattttttgtggtgcagtgatccttcttttaaccacaaatatgagttatgtcatgtacatagtatcggtattcattggcatagcaaatgctctcatgatggtaactggagtaagcatgcagaattttctcattggagagaaccttaatggttgtgcatttgttgttggatcattgagttttttggacaaaatttcatgtgggcttgctttatatgttcttcagtcaaaccaaaatctctctccgcagctccaggcaacaacccaattccccttttcagttacaaggattggtttgggtcttgttcctgcattttgtgcactagttggggtggtagtgacttgcaccatggatttccacaatccttcaaagtctttgacggcaccactattagcctag

SEQ ID NO: 3542 - DNA, 1359 bp, Glycine Max; identical to SEQ ID NO: 3541

SEQ ID NO: 3543 - DNA, 876 bp, Glycine Max
atgggtaccgtcatcgagtcccatttcttagccttcactgcccttgtcactattgcctatcagtttctgtttttcgtcgtcactgcgctcctcaaattcgacaaagtcactgattttgctggaagtacgaatttcatcataattgctgcattgaccctggtcatcaaagcctcctggtattttcgacagataatcctcactttgtttgttgggacatggggacttcgcctctgccttttcctcctattcagaattttgcagtggggagaggaccggcgcttcgatgaaatgcgtagtaatttgggtagactggccatattttggatatttcaggctgtctgggtgtgggttgtgagtttacctgttacgttggttaatgcaagcgacagaaatcccttcctacaggttgttgatatagtagggtggattttgtgggctgtgggttttattgtggaaggtacagcagatcaacaaaagctgcatttcaaaagatcttcagaaaatagagggaagtggtgtaatgttggactatggaaatattctcgtcatcctaactattttggtgaaatattgctttggtggggaatttttgtggcatctacacctgtactgaagggtgctgaatggctggtgatcattggaccaatctttctcacattattgcttctttttgtcagtggcattccacttcttgaggactcagcggataagaagtttggcaatgtagatggatataggatatacaaaaagagaaccagccctttaatcccgttgccacgatcaatctatgggaacttgcccgcatggttcaaaacaacttttctcttcgagtttccattctacagtcgtaatctaccacaagaagagaaccggtga

SEQ ID NO: 3544 - DNA, 1707 bp, Glycine Max
atgggtacgcttcagtcttggagaagagcctacggtgccatcaaggataccaccaaagtgggtcttgcccatgtcaatagcgattacgcggatttggacgttgccatagtcaaagccacgaaccacgtcgagtgtccccccaaagagaggcacctcagaaagattctgtttgccacgtctgctgtgagacctagggctgatgtcgcttactgtatccatgcgctttcgcggcggttgacaaagacgcggaattggacggtggcattgaaaacactgatagtcatccataggttattgagggagggtgatcctacttttagagaagaacttctgaatttctcacaaagaggacgaattctccaactatcaaatttcaaggatgattctagcccaattgcttgggattgctctgcctgggtacgtacctatgcgttatttttggaagaaagacttgaatgctttcggattctgaagtatgatattgaagctgagcgtctacccaaacctgtccaagggcaggagaaggggtacagcaagaccagggatttggatagtgaggagttgttggagcagttgcctgctttgcagcagctgctgtatcgacttgttggttgtcggccagaaggagcagctgttagcaattatgtgatacaatatgctcttgccctggtactgaaagagagctttaaaatttattgtgctattaatgacggcattatcaatcttgttgataagttttttgagatgcccagacatgaagctattaaagcccttgaagcctataaacgtgcgggtcagcaggcagcaagtctatctgatttctatgatgtttgcaaaggattggaactcgctaggaattttcagtttcctgtcttaagagagcctccacaatcttttcttacaaccatggaagagtacattaaggaggcaccacgagtggttacagttccaactgagccattgcttcagttgacttacagaccagaagaagttcttgcaattgaagatgctaaaccatctgatgaagaacaggagccaccagttcctgttgataataatgttgttgtctctgattctgaacctgcacctccaccaccaccaccgtcgtctcacaacaattttgaaactggagacttgctgggattgaatgacactgcacctgatgcatcgtccatagaggaaagaaatgctcttgccctagccatagtccccactgaaactggtactacatcagcttttaacacgactgctgctcagacaaaagattttgatccaaccggatgggagcttgccctggtcagcactccaagtactgatatttctgcagccaatgagagacaattggctggtggattggactctctcactcttaatagcttatacgatgaagcggcatatagatctcaacaaccagtatatggagcaccagccccaaatccatttgaaatgcaggatccatttgctctatcaagcagcatccctcccccgccagctgtccaattggcagcaatgcaacagcaagcaaatccatttggtccttaccaacaaccatttcagcctcagccacaaccgcagcagcagcagcatcatatgttgatgaacccagcaaatccctttggggatgcaggatttggagcatttcctgcccccaatcctgctcctcacccacagaacaacaatccatttggaagcacaggcttgttataa

SEQ ID NO: 3545 - DNA, 1215 bp, Glycine Max
atgggtactcaaacaacactttggtgtagagcaagaactactataagtgtaggaggtgattggaagttgttcgaatccagaatccgaaaaaagggcaccaccgtgtcaacaagtagaagcagaagctgtttttgttcttcgccgctgacactaatcgtttcttcaatgccttacgagaaggaattcgccgctgcaaaaaaagcagccactctcgctgctcgtctctgcaagaaagtacagaaggctcttctgcaatccgatgtgcactcaaagtcagacaaaagtcctgtcacagtggctgattatggttcacaagcattggtcagctttatacttgagagagaacttccttctgaaccattttcattagtagctgaggaggattcaggtgatcttcgtaaggagagtggtcaggatacgctgaagcgcattacagaacttgtcaatgatacccttgctagtgaaggatcaaatagcttttctactttaacaacagatgatgtgcttgcggccattgacggtggtaaatctgaaggtggttcagttggacggcactgggttttggatccgatagatggtactaaagggtttgtaagaggagatcaatatgctatagcgttagctttactagatgaaggcaaagttgtattgggtgtcttggcttgtccaaaccttccactggcatccattggctccaatcagcagctttcttcttcaaatgaagttggttgtctcttctttgctaaagttggtgatggaacatatatgcaagcactgggtggttctacacaaactagggtgcatgtctgtgatattgataacccagaggaagcatcattttttgaatcttttgaagcagcacactcctcacatgacttatctagctccattgcagaaaaactcggtgtcaaagcaccaccagtcagaattgatagccaagcaaaatatggagctttgtcaagaggagatggggctatatatttgcgtttccctcacaaaggataccgtgaaaaaatatgggatcatgctgctggcagcattgttgtgactgaagctggaggtatcgccatggatgctgcggggaaccctctggacttttcaaaaggaaagtttcttgatgttgtatctggtattatcgttacaaaccagaaattgaaggcatcgcttttgagagcagttaaagaagcactcaatgagaaagtttcatccttgtga

SEQ ID NO: 3546 - DNA, 1035 bp, Glycine Max
atgggtagatcaccttgttgtgacaaaaatggcctcaagaaaggaccatggacaccagaagaagaccagaaactctttgattacattcagaaacatgggtacggcaattggagagtactcccaaagaatgctggtttgcaaaggtgcggaaaaagctgtcggcttcgttggacaaactatctccgaccagatataaaacgaggtcgattcactttggaagaggaagagaccataatacaactacatagcattcttggcaacaagtggtcagctattgctactcgcttacccggaagaacagacaatgaaatcaagaattactggaacacccacattagaaaaaggcttctaaggatgggaatggaccctgtgacacataggccaaggcttgatcttttggacctatcttccatcctaagttcatctctctatggttcaacacaaatgaacatccaaagacttcttggcactcacacggtggtgaaccctgaggttctaaagttggcttcatcactcttcccctctcagcaacgcgaaaacatcaacatgtgtgcacaaaattgtgaagagaaccagctctgtgacccccaaattcagagccaaatccctcatgacttggctcaagaagcattgcctttcactcatgcacagttggttgaatccaatacgatgaacacatacccttcaattttccatgaatctggcttccaacaacattattctcaactaagtgatttgcattacaacggaattgatcataaaagctatgttcctcaattaccaagctatgattaccctccaatgtctgaatcctcaacttataacaattcctataataacagcaaccagaacttcagctacgcttcagttctttcaacgccttcttcaagtcccacaccgttgaattcgaactcgacgtttgtcaaggggagcagcagcactgaggatgagacagaaagctatgtcagtagcaacaacttgttgagatttgaaatcccagatatgctacgtatgaatgagtactcatataattaa

SEQ ID NO: 3547 - DNA, 822 bp, Glycine Max
atgggtcgtggaagaatacctatggaactcattaaggaggagaaagcctgtgaaaaaacatttcacaagagaaaaaaggggttattgaagaaagcttatgagttttccaccctttgtgcagttgatgttggcgttattatctatgctcccaaatatcttaatgaacctgaaacatggccccaagacaaagactcaagagaggtaaaacgtgtcattcaaaaatatcataacaccactagtgataggcatcctaaggtgtatgatgtgcaagagtattttaacgatagaatgaaaaagattgaaagtgagatttccaaagtgcacaaagaggagataaagctcatgtacccaacttggaatgagtcttacaatactcttggagagaaacaattgaggatgtttgttggtattctggatgccaaacttgatgcttgtaatcaaaggatgaatatgttaaagcaagattcaaagggaaaaggaatagcaaaatcggacaaaattgagacgcttactccctacatggcctcaaatttaggtagtcacctaaatttcatgtctcaaacacaacttttcactcctagtgataacaatcaagtagcattttacccatttcagcttagccaaagttctcaaccttctacgtttcatggtggtcaaagttgtgtgcaattgatggagaaaaatgcaatggtggattgggctaatcaagttggtgttggtgctaattgtgatcccaaaatgggtgtactaaaggaggatcaatctaacaaaactcaaaactcctcaccatgctactacaatggaaatatgcaaactacatag

SEQ ID NO: 3548 - DNA, 1077 bp, Glycine Max
atgggtctgaactacagaaatttgttcccaggaacaccatcaaactgtctacaagactgttcttatgatgataaatcatcatgttgtgatccttctaatttgctccctccaactcctcctatctactcagataatgatttgagccaaagtcccagcaaacacatcaaagctgaatacttgatcataagtttctccattgtagcaaccgctttcattgccctcttctgctacgccatctacgtcaagttcttctcccctcggaacacctcaattatcagaagaagaagaacaacaacaacaacaaccttgtcacagccacaaacagaacaatatttcttggacgaggaagaacatggtcctgtcgttgaccatcccatctggtacatccgcaccaccggtctccaacaagcagtcatcaccgccatcaccgtctgcaattacaaaaaagacgaaggcttgatcgaaggtacagaatgttcagtttgcctcagcgagtttcaagaggacgaaagtctcaggcttttaccaaagtgtaaccacgcttttcacttaccttgcattgacacgtggcttagatcgcacaccaattgccccatgtgtcgtgctcctattgtcactgacccaacaagggttccttcttccatggaccctactgcgtttgaaacaagttcttttgtggaggagatttttgaaaatagtgcggagaatactcaaaatagtagtgatgatttgttgaggggtgaggaagaggaaagagtgcaagaagatgaagcgtgtgaagagaacttggcttctgaacttgtggtgactgtgcagcagccgagaagatcggtgtctctggattcttcttctgctgctaagatcagtcttgctcttgctactgttgtgtcaggggaatctcacggggatcattcaaagagggttggtgggaatgggaatttggctactaaaggtggttctagttcttgttcttcgactagttcagtgaaaaggtcgctatcattcaatgccaaacacttgctatcatggtatagccgaagtcagagaaagccaaatgctcctttgagaagcttctga

SEQ ID NO: 3549 - DNA, 1878 bp, Glycine Max
atgggtgagactggaaaacgatatcattcgcagagagaccatgatggggacaggaaacatcaaaagagacgaatgactgacagagatgataggggcaatgatgaattgattgtatataggatactctgtccagatgaagttattgggagtgttattgggaagaatgggaaagtgataaattcaataaggcaagaaaccagggcgaaagtcaaggttgtcgatccgtttcctggctccaaggatcgggtaataacgatctactgctatgtcaaggagaaggaagacgttgagattgatgatgagtttgctggtaaagaacctctgtgtgctgctcaagatgctcttctaaaggttcatgtagccattgcgaattccatagcagctattggagattccgagaagaaacgaaaggatagagatgaatgtcaaatccttgttccatcaagccagtctgcaaatatcattggtaaggctggggctaccattaaaaagctgagaagtaagacaagagcaaatatcaaggttactgccaaggatgcagctgacccgacacactcatgtgctatggagtttgataattttgttgtgatcactggtgaatcagaagcagttaaaagagcactatttgcagtttcctctattatgtacaagttcggtcccagggaggacatctcacttgacacagctgtaccagaagcccctcctagtattattattccctctgatgttccagtttatcctcccggcggactgtatccagcttcagatcctattgtcacacctagagcagttcctcaaattataggcgcaacaaatgtaccagatctgcaaggttatgctgatgcaggaaattcatggccaatgtactcatctgcccttccagtcgtttctggtgttggtgcttcccggtctgaggagttaattattagaatgttgtgtccctctgacaagattggacgtgtcattgggaagggtggtagtacaattaaaagtatgaggcaggctagtggtgcccatattgaggttgatgattccaaggctaattttgatgagtgtttaatcattataactacaacagagtcgccaagtgatctgaagtccatggcagttgaagctgttctgctgatgcaagggaagataaatgatgaagacgataccactgtttcaatccggcttctagttccatccaaggtgataggttgtattattggtaaaagtggttcaatcataaatgaaattcggaagagaactaaggctgatgttcgaatctctaaaggtgataagccaaaatgtgcagatgcgaatgatgaacttgttgaggtgggtggctcagttgattgtgtgagagatgcactaatccagattatcttaagactcagagatgatgtactgagagaaagggatactggccataatccttcaataggtgctgaatccttgtacccaggtagcgctggtctttcattgccatctatgatgcattcagttcctcctgttgctgctccgatggtttatgatcatagggctgaaagtggagctggccttggcatgctttctccaagcagtccttatggtggatatggatccttgccgatgggggataatggctatggatctatgtcctcatatgccaccaagctgtatggcggtttgcctcccccatcaactctggatatgttgattcctgctaatgctgttggtaaagtgttgggtaaaggaggggcaaatatagccaatatcaggaagatttcaggagcatcaattgagatatctgacaacaaatctgctcgtggtgatcgtattgctcttatatcaggcacacctgaacaaaagcgtgctgctgaaaacttgatccaggcttttataatggcaacctga

SEQ ID NO: 3550 - DNA, 426 bp, Glycine Max; identical to SEQ ID NO: 481

SEQ ID NO: 3551 - DNA, 2928 bp, Glycine Max
atgggtgatcgcggttcgggcgctgcgaagccgatttggatgaagcaggcggaggaggcgaagctgaagagcgaggcggagaaggacgcggcggcgaaggcggcgttcgaggccaccttcaaggctttggagaacaaacatgacaagggaggaggaggaggaggaggagggagcgttgctgaatccgacagcgactccgaggaggaggagtacgaggacctggcccacaagcccattggccccgtggacccctccaagtgcaccgccgccgggaccgggatcgccggcggaaccgcgtgcgctccgtcctcctttgtggtggtggccaaggacgccgatgagaggaaggtttccggtggtggcgcgcaaatcaaggttagggtgacgcccgggttgggtgttggagggactgagcaagaagggatggtgaaggatatgggggatggaacttatactgtgacttatgtggtgccaaagagagggaattatatggttagtgttgagtgtaatgggaggcctatcatggggagtccctttcctgtgtttttcagtgcagcaggtaatagtactggagggctgttgggtttagctcctgcatcttcatttccaaatcttgttaatcaaactatgcccaacatgccgaattactctgggtcagtttcaggggcattccctggattgttgggaatgattccaggggttgttgctggagcttctggcggtgctattttgcctggaattggggcctcacttggggaagtttgtcgtgattaccttaatgggcgttgtgcgaaagttgattgtaagttgaatcacccacctcataatttgttaatgactgccttggctgcaacaacctcaatgggaacacttagccaagctcctatggcaccttctgctgctgcaatggctgcagctcaggcaatagttgctgctcaagcccttcaagcacatgcagctcaggtgcaagctcagtctgcaaaagattccactggttcacctgaaaaggctagtaaggatgatgcattgaagaaaacccttcaagttagcaatcttagccctcttctcactgtggaacagctaaaacaactctttggattctgtggcactgttgttgaatgtacaatcactgattcaaagcattttgcttatatagaatactcaaagcctgaagaggcaactgctgctctggcattaaacaacatagatgttggggggcgccctttaaatgttgaaatggcaaaatcacttccaccgaaaccatctgttgcgaattcttcacttgcttcatcatctcttcctctgatgatgcagcaagctgttgcgatgcaacagatgcaattccagcaagcactgcttatgcaacaatctatgactgcacagcaggctgctaaccgggctgcaaccatgaaatctgccacggagttagcagcagcccgagctgcagaaataagtaagaaattgaatcctgatggagttggaactgaagagaaagagacaaagcagaagtccagatcgccctctcctcctcatggaagatctcgatcaaagtcaagatctcctatcaattaccggagaaggaggaggtctcgctcttattcacctgctcgtcattctaaggatcaccgctctaggtcacccttgaggtcccatcattactcaagctatgacagggaaaggcggtcctttagagatattagggaacatagtgatagatacagaagacgagatttagatagatcacttgatcatcattcatctgcttcaagaaggaatagaagtaggagtgtaagcccttatacaaggaaatcatctgtttctccaaaacgtcatagagaaacttcacctcatagaggaaggaaacaatcacgtgctgattctggctctccaagtcgtcgcaggggaagtaggtcttctccaaagattgatgaaaaaaaactaagaaacagaaggcgctcaaggtcaagatcatcagatgataggcttcactctatcaaaaatgaagaaatctcgcatggaaagtctaaacacagagagagaaggcgatccaggtcattatctgtggatgagaagcctcacagaaggagccgatcatccccaagaaaagtggatgaaagtagatccaggcacaaaaaacggttgaggtcaaaatctgtggatgataggcatggttctcctgagagattggatgaaaacagaactagaagatcaaggcatagtgataaaaggcactccagatcaagatctacagaaactagggatcaaactgatgtcagagaggatgaacgtaaaaatcaaaagtcaaaacatcgtgatactaaaaggagcaggtcaaaatctgttgaagggaagcatcgttttaaagataaatcaggtgaaaatagagataagaaatcaaaacgccgtgatagaaagcgttcaaggtcaatatcattagaagataagcatgacaaaggagacacttcacctcatataaattttgatgagagaaactttgaaccgacaaagtcccctgaaggcaagaatcactccagtgataaatatggaagtagaggtgaaaaatcagagcatcaaaagaaaaccccatctaaatcaaaatcagaacaatttgatgggagtgggcccttacgaggaaattacaaggagtatgattcaaaaggaaaatcaccatctgattctggatctgctgaagttaagcatcatttgagtgatggagaaaatgctaccagtgaagaaaattctaaactctttggagatgtgtttcaggaaccaattagaactgcaaaggactcaacaatcctgaatgataacgggacactgacttcagtgaatggtaactacaagtcagaagagtcaagtgaaaatgcaggagctgatgataacccaggatggatatcagtggaaaaagtgggaagtggaaagtattaa

SEQ ID NO: 3552 - DNA, 474 bp, Glycine Max; identical to SEQ ID NO: 482

SEQ ID NO: 3553 - DNA, 3291 bp, Glycine Max
atgggtgcgggcccttttgttttttatgctgttcttccaaaccaggagtggcacgagagtcatggagttcatctgtgtcacaaatgtggatggccatttccaaatccacatccgagtgccaagcacaggcgtgctcataagaagatctgtggaaccattgaaggttacaaactgtccgcctccgagggacaaccccatttgaatggctcagatgacgaacatgtttctgatgatgatcacaaaacaccaggtccaaaatccttggagacaggcaacaaagagaagggcaatgaaggaaatggagaaaaaataattagatcagaagatgaggtgttctcggatgcagttgcagacttttcggatagtggatcaattccagaaatcaaggaacggttgcaagatagtttggactcaggcattttttctgatattatatcccttttactgtgtgctttgtttcttctccacggttctttcatgtctgattatctgtttctcgctgcagatgcaagtcagttaattgacaagtcaactgatgacagccaaattcaaaatcctaatatttttcaaaatgaaagtgttgaattgggaaacatggtggagttgcaaggtcaattgtcgggccctactgtggatccattgtcaagttccattgcagacttgagaaccgaagtatcaactaatgtggatagtgatgttttttttggtttgttaagtgactcacttcctggcaaagctgaagccatgcttgatatattgccagaaaagaaaatccatgctgttgagaatgtgacagattgcattttgatatctgttgcaaaggaaactaatttgaaagaaaaggatgagattaattctgctggagatgtgattgaaattgtggaatcatctgataatgttgtaggtgaaacatgtgaaggagtgtctaaaatagctgttagtgatgcaatttccttggatcatcaagtgggtgatggagctgttcatctgaaggaaaataatggcgctgagattaattcctacagagatgtggttgaaattgtggaatcatctgataaagttgtaggtgaaatgagtgaagaagtgtctaaaatagccgtttgtgatatagtttccttggatcatgaagtgggtgatggagctgttcatctgaaggaaaataatggtgctgagttcctttctttgttgcccccagataacctccctcttgagttaaactcggttgtaatcacaaatgacgcacagggagactctgcatatgtggtacagtttgctacttccagtgatgacaaaattttgccagaaaagggagaaggaaatgttaatgttgatcttcttcctacgtgtgatgatatatctgatgaagcacatcctcaaagtgagtatggagactttaaagatcttgaaggagtggtataccaaaatcctttcctacaatcatccgagtcattgaaatataagggagatgacttaaagaacaatgttactgaggaaaataaatttcatttcaatgcaaaccaattgagtgaaaaaagtgacatcctctctccagatatggatgttctagataatagcatgaagatggagctggtaaacagtgagcctacgcctaaagaagtgcatgctgaacagtgtaccgaagtttctccagcccagctcacagttgaaagtcatcaaagatcagatgagactgatgcatctatgaaagctatgaaaactgagaaaaatgaaattcatatggttcacttttctgaagagcatggacctgatgatgtgtgtaaaaattcccagcagataagtttaccagaagatagtttaatggcctcttctaatgagagtcagagggacgaatcctttaggtctgcaactagtgaaacaactagggcaattaacatagacagcacaagtcatcatgaggaaaaaataactgaaataaatgatgtagctttagatggcaaggatgtagaatctaatttagaaaatgatattgaaattatattgaaagatcttcaacctggtgacatcttgcaatctgaagtcaagcaatcagatgacttatttaagagtgacagcgctggtaagagtgatgctgctggtgaaatgggtaaaaatgaacaatgtgatattcctgatgctcaatgtatggaaaggcctactgtgagtgatgctttattgccaaaatctgctactggtcattttgaaagcccagctatttcagagtctttagacattgtggatgatggacctgtgaacaagtcaaatggtacagagtgcagaaatattaatccactaccaggttcccagaaagacataaaagaagatgaaatcaatattaatatcaaactaaatgaagaatataacaaatctgttgatacttataccgaatcccgtcaagctcaagatgctggactattagtgaaagctacagaagaccttgctagggaatatacatctttaactactgtaccttctgctcagccggacagggaagtgtctaatgctgtgcctgttcaagatcaaactggtaataacttgggtaaacttggttcatccagagttgatgcttcagttgactcaggtagccggtgtgacagtttggaagggaactggggttctgtttcagttctctcaatgcaatccgatgccccagctgttactgatgctgaaactttgccatcaactggcttgctggcatcaacagggaaatcaagcttgaacaactcaaaagctacacctgacagacagcagtctggaaactctgaaatgtttgaaccaccatctttcatgaccttggttgatcctagtcaggttagccccaaagcttctgcttctgaagtccagaaggggcagaacacacaacatacagattccacttcacaggctgcttggtttcccactctcacgcaggttgtcaacgagtctcaagggaggaagaagaatgaagaaataattgccaaggtgacaaactggagcaccagtaaggagcacactcctctgaagagcctcttaggtgaggctgcccatagtagcaagccaagatctccaaaaatggaaaactctgtgaatcagaagagtggtaaagttctggagaagaatggttctggattgacaactgttaactccattctgggtcctgaatcccctgtggctcaagtggttaaaggagaggctgcaaaagaatggaactctccagcaagatatcctgcagacatcaagagagaaaaaaggaaagtcaagagcagaccatactggatacaattggtatgctgcacgtcagtcggtcctcggtga

SEQ ID NO: 3554 - DNA, 1986 bp, Glycine Max; identical to SEQ ID NO: 483

SEQ ID NO: 3555 - DNA, 1110 bp, Glycine Max; identical to SEQ ID NO: 484

SEQ ID NO: 3556 - DNA, 1392 bp, Glycine Max
atgggtgggagcaagaagaggaagaggaagagaaacgaagagcaaaggggaggcacagtgtattcagaaagagaaaacccaccagactttgctcttttggcttctctctaccctgaatttcacccttttgttcaattcttacattctcactctcgccccaccatcgattggaccgacttcaatgccactcgccaactcacgcgcgtcttgctccatcatcgccacgctctcaactggtggattcctgatggaaacctctgtccaactgtgccaaacaggtgcaattacattcattggcttcaacaccttctctcatctgacatcattccaaacaccatttcaagtgatggcaagttcaggggatttgacattggaactggagccagttgcatttacccccttcttggtgcttctcttcatggatggagttttgttggatcagatgtgactaatgttgcaattgagtgggcggagagaaatgttaatagtaatccacatatttctcaactgattgaaatcagaaaggttcaagacaatgcaagtgatccctgtgtggaagttgaagagtcgaataggaattatcatgggcctcccatacttgttggtgtggtaagggatgatgagaagtttgatttctgcatgtgcaatccaccattttttgaaagcttggaggaggctggactcaatcccaaaacttcttgtggtggaacttctcaggaaatggtttgccctggtggtgagagggccttcattactcgtattattgaagatagtactcaactgaaggatcaatttcggtggttcacttcaatggtaggtaaaaaatcaaatctcaagtaccttacatcaaaactttgggaggttggagttgccgtagtgaagacaactgaatttgtccaaggcaggacatgccggtgggggcttgcttggtctttcttgactcccctgcagaagacaccagtttctttgcccgacaagaaaaacacgtccttcatgcttgagggtcttcaacgccaatatgcagccattaatgtgttggaagctgtcaattcttatttctcttcacatggcctatcctgtacattgaatacctcctctttcaccgtggatgttgcagcagcaaaagatgactgtgatttgatcttgaggaatggattacccattatcaataaatccatcgattgccaacctacaagagaggcatctagtggatcaagcttgaatctctcttccgagagattatgcttttgtatatcggtttttcagcaaatccctgggacactgttggtgaaaggttcattacaagacaggaatagcacattatcgggagcattctcgatgattttccaaaaactagaggaagctttgcgggataaattttgtactaaatga

SEQ ID NO: 3557 - DNA, 1770 bp, Glycine Max
atgggtggtggaggaacactcgtgcaagggattcgacgcttgtttaaacgacgcgcttcttctcctgcttctgacgatcacaaccacaacaatgtcaatgccaataatagccgcgttttagtgagagatttgcgcgcgcaattggcttcaattcccaacactcttgaccccgtttccgatttcgatttctctaccttgaagcccatcaaagttcccacaccaatccccttcagaccctcttccatggatcatcacaaaaagggtgcacaagagacagagttttttaccgagtacggggaggcaagtcaatatcagatccaagaggttgttggaaaaggaagttatggtgtcgtgggttctgctattgatactcacacaggtgaaaaggttgcaatcaagaaaattaatgatgtttttgagcatgtatcggatgccacacggatccttagagaaattaagctcttgcggttgcttagacatcctgatattgtggaaattaagcatattatgcttcctccttcgcggagagagttcaaggatatatatgttgtgtttgagttgatggaatctgacctccatcaagtaatcaaggcaaatgatgatcttactcctgagcaccatcaatttttcttgtaccaacttcttaggggcctgaaatatatacatacagcaaacgtgtttcatcgtgatttgaagccaaaaaatattcttgctaacgctgattgcaaactaaaaatatgtgattttgggcttgctcgagtttcatttaatgatgctccatcagctatattctggactgattatgttgcaactcggtggtatcgtgcacctgaattatgtggttcttttttctcaaaatacactccagcaattgatatttggagcattggatgcatatttgcagaaatgctcactgggaagccattgtttcctgggaaaaatgttgtgcaccaattggatctcatgactgatttgcttggcacacctcctcctgagtccactgcaaggattcgaaatgaaaaggctaaaaggtatcttaatagcatgagaaaaaaacaaccaattccgttctcccaaaaatttccaaatgcagatccattggctcttcgtttgctggaaagcctacttgcatttgatcctaaagaccgtccatcagctgaagaggcattatctgatccttacttcactggcttggcgaacatggaccgcgaaccatccactcaacccatttcaaaacttgagtttgaatttgagagaaggaaattgaccaaagatgatgtaagagagttgatttatcgagagattttggagtatcatccccaaatgctccaggaatatcttcgtggtggagatcaaactagcttcatgtatccaagtggggtcgatcggttcaagcgacagtttgcacatcttgaggagcattatggcaaaggtgaacgaagcactccaccattgcagagacagcatgcctccttacctagagagcgagtttgtgctcccaaggatgaaagtaaacaaaacaatgattctgaaaagccgagtggatcaaatcttcagcagagtcctccaggttctgatgagacaggtgctcaaaatggaacctccaaacaaaactacagtgcacgtagcttgttgaagagtgccagtattagtgcttccaagtgtgtagttgtgaaacaaaaaaaagatccagagcaagagccaattacggaggcaaatgatgaggcagtggatggagtgacaggtgagattgcggccctccgtgcttga

SEQ ID NO: 3558 - DNA, 1515 bp, Glycine Max
atgggtggtggaggaacactcgtgcaagggattcgacgcttgtttaaacgacgcgcttcttctcctgcttctgacgatcacaaccacaacaatgtcaatgccaataatagccgcgttttagtgagagatttgcgcgcgcaattggcttcaattcccaacactcttgaccccgtttccgatttcgatttctctaccttgaagcccatcaaagttcccacaccaatccccttcagaccctcttccatggatcatcacaaaaagggtgcacaagagacagagttttttaccgagtacggggaggcaagtcaatatcagatccaagaggttgttggaaaaggaagttatggtgtcgtgggttctgctattgatactcacacaggtgaaaaggttgcaatcaagaaaattaatgatgtttttgagcatgtatcggatgccacacggatccttagagaaattaagctcttgcggttgcttagacatcctgatattgtggaaattaagcatattatgcttcctccttcgcggagagagttcaaggatatatatgttgtgtttgagttgatggaatctgacctccatcaagtaatcaaggcaaatgatgatcttactcctgagcaccatcaatttttcttgtaccaacttcttaggggcctgaaatatatacatacagcaaacgtgtttcatcgtgatttgaagccaaaaaatattcttgctaacgctgattgcaaactaaaaatatgtgattttgggcttgctcgagtttcatttaatgatgctccatcagctatattctggactgattatgttgcaactcggtggtatcgtgcacctgaattatgtggttcttttttctcaaaatacactccagcaattgatatttggagcattggatgcatatttgcagaaatgctcactgggaagccattgtttcctgggaaaaatgttgtgcaccaattggatctcatgactgatttgcttggcacacctcctcctgagtccactgcaaggattcgaaatgaaaaggctaaaaggtatcttaatagcatgagaaaaaaacaaccaattccgttctcccaaaaatttccaaatgcagatccattggctcttcgtttgctggaaagcctacttgcatttgatcctaaagaccgtccatcagctgaagaggcattatctgatccttacttcactggcttggcgaacatggaccgcgaaccatccactcaacccatttcaaaacttgagtttgaatttgagagaaggaaattgaccaaagatgatgtaagagagttgatttatcgagagattttggagtatcatccccaaatgctccaggaatatcttcgtggtggagatcaaactagcttcatgtatccaagtggggtcgatcggttcaagcgacagtttgcacatcttgaggagcattatggcaaaggtgaacgaagcactccaccattgcagagacagcatgcctccttacctaggcaagtgttggttaaacatttggttcaaacttga

SEQ ID NO: 3559 - DNA, 2463 bp, Glycine Max; identical to SEQ ID NO: 485

SEQ ID NO: 3560 - DNA, 291 bp, Glycine Max; identical to SEQ ID NO: 486

SEQ ID NO: 3561 - DNA, 897 bp, Glycine Max
atgggttatgagagagtgagagtgctgtttcttctgtttctgataccactgccaacggttctgggttggggcaaggagggccactatgccacttgtaagattgcacaggagtatcttagtgaagatgctctatttgcggtcaaacaattgcttccagattctgctcaaggtgatcttgctgccgtttgctcttgggctgatgaggttggccatactcaccgctatcattggagcagcgctttacattacgttgacacaccggatttcaagtgtaactatgaatactgcagagactgtcatgattcttacagacatgaacataggtgtgttagtggagcaatatacaactatacaatgcaacttaaatcagctgatgcaggcatttcatctgaatttaactataacttgaccgaggcacttatgttcttgtcacattttgttggggatattcatcagcctctacatgttggtttcactggagatctgggtggaaacacaataacagttcattggtaccgaaggaaagcaaatcttcattatgtgtgggatgacttgattattcagtctgctctaaaaacattctatgactctgatctttctattatgatacaagccattcaaaggaatattacagataattggctaaatgatgtatcaacttgggaacattgtgctcacaactacacagcctgtccaaatcggtatgcttctgaaagcattagcttagcatgcaaatttgcttacaggaatgctaccccaggaagcactttgaaagatgagtacttcctttctcggctgcctgttgtggagaaaaggctggctcaaggtggtgtgcgacttgcagctatccttaaccgtattttcacttcttccaagaccagaattgctcaagcttga

SEQ ID NO: 3562 - DNA, 2016 bp, Glycine Max
atgggttcaaatcccggaattgatctctgcttccagagaaccacattgcaaaagctagctattgtagttgaagagcccacgggccctttgaaccgcacactagaatcccatacatctagtatgggactcaagtctcaagattatgttattgtgttgttgaggaatggtaggcgcaaagaacaagcaaggaatgatttgaatgtttttctgggagaaaacagctattcatttgtatcctggctctgggatcatctggatatgtatttaaatttgtatgtacaacctgaagcattgcaggatgaagctcctaaaaaaaagcttacagcggaggttcaagctggagatgatgattctcagcatttaaattcacagtcagaaagaggaaaatctagtaagttatctagaagtcggcataacaaagattggaaaggattgatgaaggaagaagctgaaccaccttccattcgaagctctgtgcctccagttcagaggaaaaggggccgagctgatgaacaacagaggatgaagcgggatgttgtatcacaagtaaatattgctgctccacggaggctgcttcaatttgcagtgcgagatgcagtagcgacttcaaggacagccaattcaggcatgtcagtggagccttccctaaaacgtcttcgttctgtagtttctacatctgctggcgattcatctttgcttgaacgtccaccgaggatgcagcttgcttccagggtggcaaatccaatggctacagtgattaaggctgtcgcagaagctgccgaagatgtgataaaatccaagccctctggaagtgtatttgatagacttggtcgcagtatggatacattagatgataacacgcaacttgaagatagtttccaacatcaggagcaacatcatttattccgttctcaaaaaactgagtacaatgggcagtatgctgcaaatatgactatgatgggacatgaaactggctatccttctgattctaattcagacaatgaagggtttgatgatattaatgtcatggatcgtagggtgtctggagcttctcagatctgcccctctgctggaaacaggggcaatgattcactgatggtgcagtatagtgtagcaaaaaatgtcgatgatagtttgcgccaaaagcgaaatcgcgaacaggagcaactttccacttcatccaacacatctcataagatagtgaatatttctgttaatgtaaatgcatggaagccaccacaacatcaggaaccacgagaggttacagaattagatggtaatagaactttttacaatgaaagagatcccagatctagtacacggccagtgaaggagaatgccaacactctaaaagttagtaatgggaatgcaaaccctgctcttgatgttcagaaagagtttagcaaggctcacttaaccgcttctggttctaatgctgctggccgtccatcagaagatgttgattccagaaccatttttgttagcaatgttcattttgctgccaccaaagatggcctgtctcggcattttaatagatttggggaagttttaaaagtgattatagttactgatgcagcaactgggcagccaaaaggggcagcttatgttgagttcatgcgaaaagaagcagcagataatgcattatctctggataacacttctttcatgtcaagaattctcaaggtatttatcacattttggttctctcaagttattaagaaaagtgctacaactcaagaatcagctccagctatggcatggccacgcattgttaggggttctccattcccttctgctaggttttccagacatccctttccaagaggtattcctggtgcttttagagcccgacccccaattaaactgggtgccaggagcatgcagtggaagcgggatgctcagggatctgacagtagttcatctgtgaatactggcagtgttactgctcctgtagctcgtgggttcacctacatcagaacagaatctaagccagaaggcagcttgagtacgacatag

SEQ ID NO: 3563 - DNA, 2376 bp, Glycine Max
atgggttcaagagtagatactgatgaagataatgataacagaggtagtatgtgggatttggatcagaagcttgaccagcctatggatgaagaggcaggaaggctcagaaatatgtacagagaaaaaaaattttcagcattgttgcttctgcggctagcatttcagagtcttggtgtggtttatggagacttgggcacttcacccttgtatgttttctacaatacatttcctaatggagtgaaagatgaggaggatgtaattggagcgctttctttgattatctactctcttaccttggtgccactcctcaaatatgtttttgttgtattaagagcaaatgacaatggccaaggtggaacatttgctctttattccttgctttgccgacatgcaaagataaaaaccattcctaaccagcatcgaactgatgaagagctaacgacgtatagtcggtctacctttcatgaaaggtcatttgctgcaaaaaccaaaagatggttagaggaacaagaatctgcgaagagagccattcttattcttgtccttgttggcacctgcatggttattggagacgggattcttaccccggctatatccgttttatcagctgttggtggcatcaaggtaaatcagcctcggatgagtagtggtgtagtagtgctggttgctgtggtaatattagttgggttcttcagcatgcaacattatggcacagatagagttagttggctctttgctccaattgtcctgctttggtttctcctaattggaggtataggcatatttaacatctggaagtatggaagcggtgttctaaaagctttttctcctgtgtatatatatcgctattttagaagaggaggaaaagaaggctggacttcccttggtgggatcatgctcagcataactgggacagaagctctttttgctgacctagcccattttccggtctcagctgtgcagcttgcatttactctagttgtgtttccttgccttcttttagcctattctggtcaagctgcttaccttatgaataacttgacccattcacaagatgctttttatcgttcaattccagatagaatatattggccagtatttattattgcgacattggcagccatagttgcaagccaggctacaataactgcaactttttcgattattaagcaagcccttgctctcggatgtttccccagagttaaagttgtatatacatcaaagaaatttctcggccagatatatgttccagatattaattggatccttatgattctttgcattgctgttactgctgggttcgaaaatcaaaaccagattggaaatgcatatggtactgcagttgttatagtcatgctggttacaacactccttatgattttaatcatgatactagtgtggcgctgccattggattctcgtcctaatcttcactggcttatcattgattgtggaatgcacatacttctcctcagtactcttcaaagttgatcaaggtgggtgggttccacttgcaattgctggagcatttcttattattatgtccgtttggcattacggcaccgtgaaacggtatgagtttgaaatgcatagtaaggtctcaatggcatggattcttggtcttggcccaagtttaggacttgttcgtgtccccggaattggactggtctacacagaacttgcaagtggagtaccccacattttttctcatttcatcaccaacctaccagccatccattctgtagttgtttttgtatgtgtgaagtaccttcctgtctacaccgtcccagaagcagagcgattccttgtcaagaggattggacctaagaatttccacatctttcgatgtgtggcacggtatggctataaagacctgcacaagaaagatgatgattttgagaaaaaactctttgagaaccttttcacattcgttcggctcgagtctatgatggaaggatgttcggattcagatgaatacagcttatgtggacagcaaatcgagcatccaagaggtggccttttgcataacaatggaagcacagtttcttccaatatggatttaacaatgtcctcagtagattcaatagtaccagttagatcaccgcatcacatgaatattactgtcaggtcttctggtcaaacaagcagccagaccgaagttgacgaacttgaatttttgactatctgcagggatgctggggtggttcacatactgggaaacacagttgtgagggcaaggagggaatcaaggttctacaagaaaatagctgttgattatatatatgcatttcttaggaagatatgcagggaaaattgtgtaatcttcaatgtccctcatgagagtctcttaaatgttggtcagattttctatgtatag

SEQ ID NO: 3564 - DNA, 582 bp, Glycine Max
atgggttccaaaggggcaaaaaatctagcactctcttcagccttgttgctccttttggtcggttttgcaacctcagacatcaatcaagacaaagcagaatgtacggataaacttcttggtctagctggttgtctttcctatgttggtggcgaagccaaagtccccaccatggattgttgctctggtatcaaagaggttattaacaagagcaagaggtgcctctgcatcctcatcaaggatcgtgatgatcctagtcttggcctcaagatcaacgtcacccttgctttaaacttaccagatgtttgtgaaacacccactaatataactcagtgtgttgatcttttgcatttggcacccaagtcccaggaagctaaggtgtttgaggggtttgaaaaagccttgaccaacaaaactagtccctccccggtccttagtgctaataacacaactgcaaagggaacaagcacaagcgcgaacaacaacagcggaggtgggtggggaaagaggtggttagtggcagaggtggtgtgtgtgattttaccgattgtttttatttcccattttttcttgttcctagtttga

SEQ ID NO: 3565 - DNA, 2292 bp, Glycine Max
atgggttccaaggcgaagaagaagggttcaccggaggacattctggaaaccctaggagacttcacgagcaaagagaactgggacaacttcttcaccctccgcggcgattccttcgagtggtacgccgaatggccccatctcagggacccactcctctccctcctcaaaaccatccctctccctctcccgcttcagctcctcgtccccggctgcggcaactcccgcctctccgagcacctctacgacgccggccacaccgccatcaccaacatcgacttctccaaggtcgtcatcggagacatgctccgccgcaacgtccgcgaccgccccctcatgcgatggcgcgttatggacatgaccgtcatgcagttcgaggacgagagcttcggtgcggtcattgacaaaggtggactcgatgctttgatggagcccgagcttggccccaaattggggaaccagtacctatcagaggtgaagagagttttaaagcctgggggcaagtttgtgtgccttaccttggctgaatctcatgtactaaatctacttttctcaaagtttcgacttgggtggaaaatgagtgttgatgccatacctttaaagtcttctggtaaacctagccttcaaacgtttatggttgttgtggagaaggagctgtctactttagtgcatcagattacatcattgctccataattcttcacttcatagtaattcaaaacaggtttctggactccacgaggctcttcaaaatgagaatcaaattcgtgaaaaatactccagtggctctgatatattatattctgtggaagatctgcaagaggagttgacaaagctttctcaaggtcgacgattgcagctaactttggggggacaagggtactccactttttcttacagagctgtaattcttgatgctgaggaacaggctgacccatttacctatcactgtggggttttcattgtgcctaagactcgtgcacgtgaatggcttttctattctgaagaaggacagtggatggtggtcagaagctccaaagcagctcgtctcataatggtttacttggatgccagccattcagataccagcatggaggagattcagaaggatttgtctccgttggttacacagttggcacctgcagaaaatgggaatggagctaaaatacctttcatgatggcaagtgaggggatcaaggagcgaaacatcattcataaggtcacatcttcattaactggatcaattattgttgaagatgtaatttatgaaaatgttgatagtgaagtcagttgtatttttccttctggagagttgatgtttcgacgccttgtattcgagagagctgcaaatttggtgcagtctgaagctttgctaaaagatgaacagttgcctaccaaattggttagtgagacagggaagaagaaaaacaatgcatcttccaaatctaggaaaagtggatcttggagagacagtgttggagcaagcagtcagttgactgtctatcatggctatgtagctagttcttatcatacagggattatttcaggattcatgctaatatcttctcacatggaaaatgtggcatcaagtgggaaaatggtaaaagctgtaataataggtcttggagcaggtttacttcccatgtttcttcacggatgtatcccctttttggaaattgagactgtggagttagaccccatgattgttgatattgcaagggactacttcagttttgttgaggataaacatgtaaaggtgcatatagctgatgggatccagtttgtccgggagattgacagttctggagcagctcagattcatggaaaaagtaatgatcctagctatacagataccgctttaaatgcaagttcagctgtgtctcatgctgatgtagaagtgacaaaagttgatataattattgttgatgttgactcttcagacccaagctcgggattgacatgccctgctccggattttttggatgagtcttttcttgagactgtaaaggatagactttcagaggatggtctctttgttgtcaatttggtgtcacggtcccaagccattaaagatatggctctctcaaaaatgaaaaaggttttcagccacctcttctgcctccagcttgacgaggacgtcaatgaggttcattttgccctcaaatctgagtcctgtattgaggatagctgtttctccgaagcttctcttaaacttgataaattgttggagttcaaacacccggagataggtcaaaacattatcaatgcgacaaaaaagatcagacgtacaatataa

SEQ ID NO: 3566 - DNA, 1755 bp, Glycine Max
atgggttccacagagaatgaattatcgctcgctgaagaggctcttcttcaggatgatgaaagcaaacaatacacaggagatggatcggttgactttaaagggaggcctgttcttaaacggaatactggcaattggaaggcttgcccatttatcttaggcaatgagtgctgtgaacgtttggcgtactatggcattgcgacaaatctcgttacctatcttacccagaagcttcatgaaggaaatgtctctgctgcaagaaatgtcaccacctggcaaggcacttgctatcttgcacctctcattggagctgttttggcagatgcttattggggacgatactggacaattgccattttctccaccatttatttcataggaatgggtacattgactctttctgcatcggttcctgctttgaagcctgcagagtgtttgggtactgcatgtcctccagctactcctgcacaatatgctgtgttcttctttggcctctacctgattgcacttgggactggtggtataaaaccatgtgtgtcatcttttggggcagatcagtttgatgatactgatccccaggaaaggattaagaagggatcctttttcaactggttttacttttctatcaacataggtgcccttgtttccagcacttttattgtttggattcaagaaaatgctggctggggtcttggatttggcattcctgctttatttatggcattagctattggaagtttctttttaggcactcccctttacaggtttcaaaaacctgggggaagccctattacgagaatgtgccaggttgtggtagcatctgtctggaagcgaaatctggttgtccctgaggacagtaatctcctatatgagacaccagataagagctctgcaattgaaggaagtcggaaactagggcatagtgatgaactaaagtgtcttgatagagcggctgtagtgtctgatgctgagagcaaaagtggtgattattctaaccagtggagactttgcaccgtgacacaagtagaggaattgaaaatcttgattcgaatgtttccagtttgggctactgggattgtttttgctgctgtttatgctcagatgtcaacattgtttgtggaacaaggaacgatgatgaacacaaattttggttccttcaggattcctccagcttccctctcgagttttgatgtgataagtgttattttctgggtccctgtctatgacaggattattgttcccattgcaaggaaatttacaggcaaggagaggggcttttcagagttgcaaagaatgggaattggcctttttatttcagtcctgtgcatgtcagcagctgctatagtggagattgtgcgcctgaaggttgcaaaagagcatggccttgttgatgaacctgttcctgtaccccttaatatattttggcaaatccctcagtatttcttattgggggcagcagaagtattcacattcgtcgggcagcttgagttcttctatgaccaatctccagatgccatgcgtagtttatgtagtgctttgtcgctgttgactacttcacttgggaattacttgagctctttcattctcactgtagtgacttacttcactacacaaggtggaaatcctggatggattccggataacttgaacaagggtcatcttgattactttttctggcttttagccggacttagcttcttaaatacctttgtgtacatagttgctgccaaaaggtacaagcagaagaagtctgcttaa

SEQ ID NO: 3567 - DNA, 1158 bp, Glycine Max
atgggttctagagcacgttggcgccagagttgggctccacagcccttgacacccttaatggaaggccctggccctgaaatgcaagaggaaggaaccaagaaagagagttcatgggaagtaataagggaatggttcaggactcagaagatctccccaagtggaagtttttcacaatcatcatcatcattctatggaaccattcatgccaagacacaagatttgaggctcttgcttggtgtcttgggctgtcccttggctcctattccctcagcacatgatcccactcttagcattcacatcaaagacaccccatttgaaacttcaactgccaaatacattatccagcagtatttggcagccacggggtgcctaaaacagcaaaaggacactaaaaacatgtatgccactgggatggtgaagatgatttgctgtgagacagagatttcatctgggaagaatgtcaagtgcttgggtacaagaagcagtgaaaatggttgctttgtgctttggcagatgcaacctggtatgtggtctcttgaattggtggttggtgaccacaaggtggttgcaggcagcaatggcaaaaccgtgtggcggcacacaccatggcttggcacacatgcagccaaaggcccccaaagaccccttcgtcgcctcattcagggcttggatccaaagaccacagcgagtttattcaccaacgcgcaatgcttgggcgagaatcgaattgggaccgtggattgcttcgtgctaaaggtctcggccgatcgtgcggcagtggttgaaaggagtgagggccccgcagaggtgataaggcacattctatacggttacttttgccaaaagagtggactcctcatatacctagaagactctcacctcacaagggtcccaacacaagacaatgatacggtgtattgggagaccaccatagggagcagcatcggcgactaccgggacgttgatggcatcctcattgcacatcaagggcggtccgtcgcaacggtgttccggttcggggagctctcgatgcagcatagccggacccggatggaggagatttggaccattgatgatgttatgtttaatgtacctggactctccatggaccatttcattcctccagctgatatctttgacaatataaattctccatga

SEQ ID NO: 3568 - DNA, 1257 bp, Glycine Max; identical to SEQ ID NO: 487

SEQ ID NO: 3569 - DNA, 900 bp, Glycine Max
atgggttctctggcccgaccaaactcactcttttttcgaaccaaaggacccggacgtgcccggaaagtaccaagtcaggttttggcttttcagcgttccaattcaaatggttcatttccctcatcagaacagctagaacttgaagcaagccagaagaacatggaagcacctgttgttgtagtcactggagcctccagaggcattggccgtgcaattgcactttccttgggtaaagccccatgcaaggtgttggtcaactatgccaggtcatccatgcaagctgaggaggtttccaacttgattgaggcgtttggtggacaagctcttaccttcgagggagatgtttcaaatgaggccgatgtggaatctatgattagaactgcagttgatgcttggggaactgttgatgtattggtaaacaatgcaggaattactcgagatggtttgttaatgagaatgaagaaatcacaatggcaggaagttattgatctgaatctcactggtgtttttctttgcatgcaggcagcagcaaagattatgacgatgaaaaagaagggaaggataatcaatattacatcagttattggtcaggttggcaatgttggacaagccaattatagtgctgcaaaggcaggggtaattggcctcacaaaaagtgctgccagggaatatgctagcagaaacatcactgttaatgcagtagcccctgggtttattgcatctgatatgactgccaatctacgaccaggcattgagaaaaaaagattggaattaatccccttaggaagacttggccaaccagaagaagttgctggacttgtggaattcttggctcttaatcctgctgccaattacatcactgggcaggtgttcaccattgatggaggtttggcaatgtga

SEQ ID NO: 3570 - DNA, 651 bp, Glycine Max
atgggtttagtggcaccttactctgctggaacatgtcttccttcccttcaacgccttccaaccctgcaagcccaaaaatggaacaacttctcagcacctcttagttgccaccgccaagtgaaatgtgctgtccaagtccaaccacaagtagcaccacgaattacacctgatgagagcctgcaggtgaagagaagaactctcataggccttctagcatttgatgctgtccttgcttattcttcattgcaagcagcaccagcagctgaaaatccgtgtgaatttcaagtggcaccttcaggccttgccttctgtgacaaacttgtgggagctggtcctcaagcagtgaagggacagcttattaaggcgcattatgtggggagattggagaatgggaaagttttcgatagcagctacaatcgtggcaagccactaacctttcgcgtcggtgttggagaggtcattaaaggttgggatgaaggcattataggaggtgatggagttccccccatgcttgcaggagggaaacgtacactgaagattcctccagaacttggatatggctcaagaggggctggttgtaggggaggttcatgtatcattcctcctgattcggtattattgtttgacgtggagttcgttagcaaagcatga

SEQ ID NO: 3571 - DNA, 276 bp, Glycine Max
atgggtttcataatggaattcgcggagaacttggtattgaagttgatggaggatccgaaggaaagggatcggaggttccgggagcacgtttatagagtgaaggacaggtgcgagaagacgaaggagatgtggagctaccctatgcgaccctatgggttttggactttcgaacgccacaattctcagcttgcttgggatgcacagattagccaagtggctgggaggagggacccttatgatgatatcctccaacatttctctaccccacctaagtga

SEQ ID NO: 3572 - DNA, 282 bp, Glycine Max
atgggtttccgtataccaggtattattagacaggcatcattttctacagccaaagcaactcacaaggaacttgaagtcccaaaaggctatcttgcagtctatgttggagataagatgaagcggtttgtgattctggtatcatacttgaaccaaccttcatttcaagaattactgagtcaagcagaagaagagtttggatatgatcatccaacaggcagtctcacaattccttgcaaggagaatgagtttctaaacctcacttctcgcttgagtgagctataa

SEQ ID NO: 3573 - DNA, 1140 bp, Glycine Max
atgggtttccttgtgttgcttcttttctccctcttaggtctctcttctagttccagcatatcaactcatcgttccatattggaccttgacctaaccaagtttaccacacagaaacaggtgtcttcactgttccaactatggaagagtgagcatggacgtgtctaccataaccacgaagaagaggcaaagagacttgagattttcaagaataacttgaactatatcagggacatgaatgcaaacagaaaatcaccccattctcatcgtttaggattgaacaagtttgctgacatcactcctcaagagttcagcaaaaagtacttgcaagctcccaaggatgtgtcgcagcaaatcaaaatggccaacaagaaaatgaagaaggaacaatattcttgtgaccatccacctgcatcatgggattggaggaaaaaaggtgtcatcacccaagtaaagtaccaagggggctgtggaagcggttgggcgttttctgccacgggagccatagaagcagcacatgcaatagcaacaggagaccttgttagcctttctgaacaagaactcgtagactgtgtggaagaaagcgaaggttgttacaatggatggcactatcaatcgttcgaatgggttttagaacatggtgggattgccactgatgatgattatccttacagagctaaagagggtagatgcaaagccaataagatacaagacaaggttacaattgacggatatgaaactctaataatgtcagatgagagtacagaatcagagacagagcaagcgttcttaagcgccatccttgagcaaccaattagtgtctccattgatgcaaaagattttcatttatacaccgggggaatttatgatggagaaaactgtacaagtccgtatgggattaatcactttgttttacttgtgggttatggttcagcggatggtgtagattactggatagcgaaaaattcatggggagaagattggggagaagatggttacatttggatccaaagaaacacgggtaatttattaggagtgtgtgggatgaattatttcgcttcatacccaaccaaagaggaatcagaaacactggtgtctgctcgcgttaaaggtcatcgaagagttgatcactctcctctttga

SEQ ID NO: 3574 - DNA, 279 bp, Glycine Max
atgggttttcgtttacccagcatcagaaggtcatcattcgctgctaaccaaacatcttcaaaagctgtggaggtgccaaagggctatcttgcagtctacattggagagagaatgaggcggtttgtgatccccatatcatacttgacccaaccttcattccaagacttgttgagtcaagctgaggaagagttcggatataatcatccctggggtggtcttacaattccttgcagcgaagatgtcttccaaagcataacttcacatttgaatggactataa

SEQ ID NO: 3575 - DNA, 279 bp, Glycine Max
atgggttttcgtttacctggtatcagaaggccatcatttgctgcaaacatagcatcttcaaaagctggggaggtgccaaagggctatatcgcagtctacgttggagagagaatgaagcggtttgtgatccctatatcatacttgtcgcaaccttcattccaagacttgttgagtctagtggaggaagagttcggatacgatcatcccatgggcggcctcacaattccttgtagcgaagatgtcttccaacatataacttcttctttaaatggacaataa

SEQ ID NO: 3576 - DNA, 945 bp, Glycine Max
atggtaaaatcaacatatgagaaattttcaaaggactttgtgatggggggagtagcagcaatcatatcaaagagtgcagcggcaccaattgagagagtgaagcttttattgcaaaaccaaggtgaaatgattaaaagaggacagctcaaaaaaccatacttgggtgtgtctgatggctttaagagggtcttcatggaagagggtttgattgccttttggagaggacaccaggccaatattatccgatatttccccacacaagctttcaattttgcattcaaaggttacttcaaaagcatttttgggtattccaaagagagagacgggtacattaagtggtttgctgggaatgtggcttcaggcagtgctgcaggagcgactacatcactacttctgtatcatttagattatgcacgtactaggttgggcaccgatgcaatagagtgccgtgttaccagtcaacgccagtttaaaggactaattgatgtataccggaagaccttatcaagtgatggaattgctggcttgtacaggggatttgggatttcaatatggggaatcaccttgtatcgagggatgtactttgggatctatgacaccatgaagcctattgttttagttgggccttttgaggggaagtttcttgctagtttcttattaggttggagcatcacaactttttcaggggtttgtgcataccctttcgacacattgcgccggcgaatgatgctcacctctgggcatccaaacaagtactgtactgcaatacatgcatttcaagagattgttcgacaggagggtttccgagctctatttcgaggagttaccgcaaatatgcttcttggcatggcaggagctggggtgcttgctggatacgatcagctgaaccgtatctcatctagacacagtcactataatgagacaaaccaaagagttctgaaatga

SEQ ID NO: 3577 - DNA, 1464 bp, Glycine Max
atggtacacgaagcaagtgagtacattaaaaagtgtttaggtggtggagaagatgatgcacttatattatgtggctcgggcacaactgcagctatcaagaggcttcaagaagtgatgggaatcgctgtgccatctgttttgagggaaagggttttgaagagccttagcacagaagaaagatgggtggtttttgttggacctcatgagcaccattcaaacctcctttcttggaggcaaagcttggctatggtggtagagattggtcttgatgataaagggttgcttgatatggatgctctaaagctacaacttgaggcctacaaagacaccaatcgacccatgttgggatctttctcagcttgtagcaatgtcacgggaatctactcagatacacgagcaattgctcagcttcttcatcggtacaaagcctttgcatgctttgatttcgcagcaagtggtccatatgtggagattgacgtgaggtcaggggagagtgatgggtatgatgcagtgttcctgagtccacataagtttcttggtggtcctgactctcctggtgtgctcctcatgaacaaggccctgtacctgctaggatcttcaccaccgtccacttgtggaggtggaaccgtgacttatgtcaatgccttcaatgaacaggatacattatacttggagaacatagaggaaagggaaactggggggacgcctccaataatccagacagtgagagcagcattggcattttgggtgaaggaatatataagctatgaagatattgaaaaacgggaacaactgtacattaacaaggcactcgagagacttggttcaaaccccaacattgaggttctaggaaacttaaaggccaagagacaagctatattgtcatttctgatatactctaccaccaccaattcttgctcagctggtgagtggagtgatggtaacaaagaaaatgaaggggagcttgatttgtgggcagaaacggggaaccaaagaggtaaaccacttcatggtccttttgttgcagcattgctcaatgacctctttggaattcaagctcgaggagggtgtgcttgtgctggaccttatggacacgaattgctccacatcaacaagtctcattcacttgccattagatcagcagttcaagagggctatattggagtaaagccagggtggactcgagtaagttttccatactacatgagtgaagaggattttgagtacattctgaaagccatagagtttatagctgtgtatggccaacgattcattcctctatatagtttcaatttgataaatggcagctggagattgaagacacagaaatttgaggcacaaaccaaggaaggcactgacaaatttgaggtggctaaatgtgttgctagtagcctccgcaaattcccttctcagggtatactccaggaggaagtggatcccaatatcttctgctttagaatttaa

SEQ ID NO: 3578 - DNA, 561 bp, Glycine Max
atggtagatccagctactgaattggtgccaccaccatcttcacccaccaattcatccatttcctcctctgatcttgacaccgagtctacgggatcctttttccatgacagaagcaccacactgggcactcttatgggtgtcagcttcccagctattaccttcagagcctccgacccccatccaaattccgccaccgccaccgccaccgctgctgccggaggccctcgtagggctgcgggctccaagaagaagagggcgatcgcggtggcggagaggcggaggaggtggtggtggctgtgcagggacggtgacgcgaggccggcttcgctcggtgagtttctcgaggtggaacggcgctgcggggacggcgccttttacggcacggcggcggaactcgaaggaatggtgatggacccgcagagtagccatggccgggctttgttttccgacgggagggttcttccgccggctggcgttgatgacgatgcgtcgacggcggggagtctttgtcgtagattcccggttttgctcaccgggatctgtagcggcggtgctggataa

SEQ ID NO: 3579 - DNA, 738 bp, Glycine Max; identical to SEQ ID NO: 488

SEQ ID NO: 3580 - DNA, 1458 bp, Glycine Max
atggtaggaagtgttgatgttctagctcatgattccagcattaatggaacaatgaaacagtggcctgaagatttcagttccatgacgattatgagagatcatgtgacactcacaattggagagaatggcattggcaatggggttgttcagaatggtacagaaaatggagaaagaaagatagtgcttggaagaaatattcacaccacgtgccttgaagtcactgagcctgatatagatgatgaggttactggggaaagggaagcttatatggcaggcgtgttggctaaatacaaaaaatctctgactgaaaggaccaactatcatttaggatacccctataatttgaattttgactatgatgcactctctcagcttcagcatttttccatcaacaacctgggggatcccttcattgaaagcaattatggtgtccactctaggcagtttgaggttggtgttttggactggttcgcgcggttgtgggaactcgagaaagatgagtattggggctatataacaaactgtggcacagaaggcaatctccatggcatcctagtggggagagaggttttccctgatgggattttatatgcctcacaggaatcacattattctgttttcaaagctgctagaatgtacagaatggaatgtgtgaagattaacactctttggtctggtgagattgattgtgatgattttaaggccaagcttctttgtcacaaggacaagccagcaattgtgaatgtgaacataggtacaactgtgaagggagcagtggatgaccttgatctggtaataaagaaactagaagaggcaggattttcacaagacaggttctatatccattgtgatggggctttgtttggtctcatgctgccttttgtcaaacgtgctccaaaaatttcattcaagaaaccaattggtagtgtgagtgtctcaggccacaaattcgtggggtgccccatgccctgtggcgtgcagataacacggttggagcacgtcaacgctctttccagaaacgtcgaatacctggcttcaagggacgccacaatcatgggaagcaggaacgggcacgcccccatattcctctggtacagcctcaacatgaaaggctacagaggcttccagaaagaggtgcaaaagtgtttgaggaatgcacactacttcaaagatcgccttgtggatgctggcattggagcgatgctgaatgagctcagcagcaccgttgtgtttgagaggcctcacgatgaagggtttgtgcacaagtggcagcttgcgtgccaaggaaacgttgcacatgttgtggtgatgcctaatgtcaccattgagaaacttgatgattttctcaatgagcttgtgcagaagcgtgctgtgtggtttagagatgggaactgtcaaccctattgtatagcttctgatgtaggacaggaaaattgcctctgtgctctgcacaggtaa

SEQ ID NO: 3581 - DNA, 1242 bp, Glycine Max
atggtagtggttgtagatgacgaggacagggaaaatgaaggagacttgataatggcggcacagttggctacacctgaggctatggcttttattgtgaagcatggaactgggatagtttgtataagcatgaaggaggaagatttagagagattggagctgcctttgatggtgaacagtcagtataacgatgagaaacttcgcaccgcgttcactgtgacagtggatgctaaatatggtactaccacaggggtgtcagctcatgatagggcaacaacagtcttggcccttgcatccaaagattcacaaccaagtgatttcaaccgcccaggccatatcttcccactaaaatacaaggagggtggtgtgctgaagagagctggacatacagaagcttcagttgatcttgccattcttgctggtttaaatcctgtggcagttctgtgtgagattgtagatgatgatggttccatggctagattacctaagcttcgccagtttgcagagcgtgaaaatttaaaaattgtatctattgctgacttaataaggtatagaaggaagagagataaactaatagagcgtgctggtgctgcactaataccaacaatgtgggggccatttgtagctaactgctataggtcacttttagatgggattgagcatattgctatggttaagggtgacattggggatggacatgatgttcttgtaagggtacactcagagtgtctcacgggagacatatttggctctgccagatgtgactgtggaaatcagcttgctcttgcaatgcaacagattgaagctgctggtagaggtgttttggtttatcttcgtggacatgaaggaaggggtattggcttgggccacaaactacgagcttataacctacaggatgatggacgggacaccgttgaagccaatgaggagttgggattgcctgtcgactcaagggaatatggaattggtgcacagattttgagggacttgggtgttcgatctatgaagctaatgacgaacaatccagcaaaatatgttgggctcaaaggttatggtttgacaatttccggtaggatcccattggtatcacttatcacaaaagagaacaagcgatacttggagaccaaacgtgtgaaaatgggtcacgtatatggctcggaatttaacagcaaattgaactatcaagacagtggcaatggtaaagtcaatagtgatgatgattctaatgctgctcctggcttataa

SEQ ID NO: 3582 - DNA, 768 bp, Glycine Max; identical to SEQ ID NO: 489

SEQ ID NO: 3583 - DNA, 642 bp, Glycine Max; identical to SEQ ID NO: 490

SEQ ID NO: 3584 - DNA, 540 bp, Glycine Max; identical to SEQ ID NO: 491

SEQ ID NO: 3585 - DNA, 951 bp, Glycine Max
atggtcagtgttgaagagatccgtaatgcacaacgtgcagagggccctgccactgtcatggctattggcaccgcaactcctccaaactgtgtcgatcagagtacctatcctgactattatttccgcatcaccaacagcgagcacatgaccgagctcaaagaaaaattcaagcgcatgtgtgataagtcaatgattaagaagcgatacatgtacttaaatgaagaaatcctgaaagagaatccgagtgtttgtgcttacatggcaccttcgttggatgcaaggcaagacatggtggttgtggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgcccctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacattccgcggcccaactgacacccatcttgatagccttgtgggtcaagccttgtttggagatggtgcagccgctgtcattgttggatcagaccccttaccagttgaaaagcctttgtttcagcttgtctggactgcccagacaatccttccagacagtgaaggggctattgatggacaccttcgcgaagttggtctcactttccatctcctcaaggatgttcctggactcatctccaagaatattgagaagatggaaagtgagaccaacttcgcgaaggtgtccatcaatagccccttcactgtctggaaggattgtctgggcagtccagacaagctgaaacaaaggcttttcaactggtaa

SEQ ID NO: 3586 - DNA, 1167 bp, Glycine Max
atggtcagtgttgaagagatccgtaatgcacaacgtgcagagggccctgccactgtcatggctattggcaccgcaactcctccaaactgtgtcgatcagagtacctatcctgactattatttccgcatcaccaacagcgagcacatgaccgagctcaaagaaaaattcaagcgcatgtgtgataagtcaatgattaagaagcgatacatgtacttaaatgaagaaatcctgaaagagaatccgagtgtttgtgcttacatggcaccttcgttggatgcaaggcaagacatggtggttgtggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgcccctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacattccgcggcccaactgacacccatcttgatagccttgtgggtcaagccttgtttggagatggtgcagccgctgtcattgttggatcagaccccttaccagttgaaaagcctttgtttcagcttgtctggactgcccagacaatccttccagacagtgaaggggctattgatggacaccttcgcgaagttggtctcactttccatctcctcaaggatgttcctggactcatctccaagaatattgagaaggccttggttgaagccttccaacccttgggaatctccgattacaattctatcttctggattgcacaccctggtggacccgcaattttggaccaagttgaggctaagttaggcttgaagcctgaaaaaatggaagctactagacatgtgctcagcgagtatggtaacatgtcaagtgcatgtgtgctattcatcttggatcaaatgaggaagaaatcaatagaaaatggacttggcacaaccggtgaaggccttgactggggtgtgctatttggtttcggccctggactcaccgttgagactgttgtgctccgcagtgtcactgtctaa

SEQ ID NO: 3587 - DNA, 1167 bp, Glycine Max; identical to SEQ ID NO: 3586

SEQ ID NO: 3588 - DNA, 1167 bp, Glycine Max
atggtcagtgttgaagagatccgtaatgcacaacgtgcagagggccctgccactgtcatggctattggcaccgcaactcctccaaactgtgtcgatcagagtacctatcctgactattatttccgcatcaccaacagcgagcacatgaccgagctcaaagaaaaattcaagcgcatgtgtgataagtcgatgattaagaagcgatacatgtacttaaatgaagaaatcctgaaagagaatccgagtgtttgtgcttacatggcaccttcgttggatgcaaggcaagacatggtggttgtggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgcccctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacattccgcggcccaactgacacccatcttgatagccttgtgggtcaagccttgtttggagatggtgcagccgctgtcattgttggatcagaccccttaccagttgaaaagcctttgtttcagcttgtctggactgcccagacaatccttccagacagtgaaggggctattgatggacaccttcgcgaagttggtctcactttccatctcctcaaggatgttcctggactcatctccaagaatattgagaaggccttggttgaagccttccaacccttgggaatctccgattacaattctatcttctggattgcacaccctggtggacccgcaattttggaccaagttgaggctaagttaggcttgaagcctgaaaaaatggaagctactagacatgtgctcagcgagtatggtaacatgtcaagtgcatgtgtgctattcatcttggatcaaatgaggaagaaatcaatagaaaatggacttggcacaaccggtgaaggccttgactggggtgtgctatttggtttcggccctggactcaccgttgagactgttgtgctccgcagtgtcactgtctaa

SEQ ID NO: 3589 - DNA, 225 bp, Glycine Max; identical to SEQ ID NO: 492

SEQ ID NO: 3590 - DNA, 738 bp, Glycine Max
atggtctcacagacagttgaactcttaaagaatgagattcctctggagcaggaatcagtggttttagctgaagatgctgtaaatggtctcgttcttgtggacatcataaatggcttttgcacagttggtgctggaaatctggctccaagagaatccaatacgcagatttcgggaatgatcagtgaatcagcaaggctggctagagtgttctgtgagaagaatttgccggttatggctttcctggattctcaccatcctaacaagccagaggacccttatccccctcactgtattgttggctctgatgaatcaaatctggttccagcattaagatggctagagaatgaacctaatgtaacaatcaggcgaaaggattgttttgatggatatttgggctcaatacaagaagatggttcaaatgtttttgtagattgggtgaagaagaataagataacaactctgctggtagtaggtgtgtgcacagatatctgcgttctagattttgtatgctccacaatgtcagctaaaaaccgtggttttctggagcctctagaaaatgtggtggtgtattcccgtgcctgtgctacctttaatgtccctctggaggtagccagaaataccaaaggagctttggcacatcctcaggagtttatgcatcatgtaggcctatatatggccaaagaacgtggagccaagatagcaaatgaagtattgtttggtgcagcagggaaggtttaa

SEQ ID NO: 3591 - DNA, 2100 bp, Glycine Max
atggtctcggcagcaccaaatgcaatgtatgcccagttgtccaaccttagtttctcccatcacttcttagtgatgttgttatccattttcttcatcttcattatcccttgtgctttccctctatcctttaacatcactagtttcgatccaaatggcaagagcataatatatgagggatcagccaaccctgtaacaccagttatcgaactcacaggaaacgtacgggacagcacaggtagagccacatatttccaacctatgcacctgtgggacaaagccacagggaatctcacagatttcactacccatttctcctttgtcatagattcacggaaccgaagtggatatggagatgggatggcattcttccttgcccctgctggtttaaagtttccttatgtctccagaggaggtgctttgggtctgacacttgagaaccaacgattaaactccactgacccatttgttgctgtggagtttgatatctataagaatttctatgatccacccggtgaacatgttggaatcgacatcaactctttgagatctgttgccaatgtcacatggttggctgatatcaagcaagggaaactcaatgaggtttggatcagttacaattctagttcatttaatttaagtgttgtgttcacgggttttaacaatgacaccattctgcggcaacatctatctgccataattgatctgagacttcatttaccagaatttgttactgttggcttctcagctgccacgggaagttcaactgctatacatagtgtcaattcatgggattttagctcaactttggcagcacaagaaaacataacaaagggagcagacacagttgccagtcagaagaaaaagaataagaccggcttggcagtgggattgagtattggtggatttgttttgattggtgggttgggtttgatttctatatgcttgtggaagaagtggaagaaaggaagtgtagaggaagttcatgtttttgaagagtatatgggaaaagattttggaagggggggaggacccaggaagtattcatatgctgaattaacacaagcagctaatggtttcaaagatgagcacaagctaggacagggaggatttggaggtgtttataagggttatcttaaagacataaagtctcatgtagctattaagagggtgtcagaaagctctgatcaagggataaaggagtttgcttcagaagtaaacattattagccggttaaggcatcgaaatctagtgcacttgatcggttggtgtcatgcagggaaaaagctcttacttgtgtatgagtacatgccaaatggaagcttagatattcatcttttcaagaagcaaagtttgttgaaatggacggtgagatataacatagctcgaggattggcctccgcattgctatacttgcacgaggaatgggaacaatgtgttgtgcacagagacataaagtcaagcaacattatgctggattcagagtttaatgccaaacttggggattttggcttagcaaggtttgtggaccatgcaaaaagtgcacaaactacagctttagctgggactatgggctacatggctcctgaatgtgctacctcgggcagggctagtaaggagtcagatgtctacagtttcggagttgttgctttagagatagcttgtggaagaaaacccataaaccatagggctcaagaaaatgaaataaatattgtggaatgggtgtggggactctatggagaagggagaattcttgaagcagcagatcaaagactagaaggggaatttgaggaggagcaaataaaatgcttgatgattgttggtctttggtgtgctcaccctgaccataacaataggccttcaatgaggcaagcgattcaagtgcttaactttgaagctcccttgcctaatcttccatcaagtttgcctgttcctacatatcttgaaggccccttgcactcattcatagcaccattcagcataacttcttcggaggaaggtcaaagccagatcacaggctccagttccaacacaaactccaccgggttcaccacaaaatctgatgatgcttctccttctgtgtcgcttctgtactcacggtga

SEQ ID NO: 3592 - DNA, 462 bp, Glycine Max; identical to SEQ ID NO: 493

SEQ ID NO: 3593 - DNA, 1305 bp, Glycine Max
atggtcttagaagagagtgtagtgcatgatgtgaggctatcctcagttgggccgggccgggccaccgggtcggacgtattccacaacccgggtggcttggacttggccatgaagcttcactaccttagagtggtgtacttctttgatagtgaggctgcacaagacctaaccatcatgaaaattaaggatggcatgttcactttgttcaaccattacttcatcacctgtggccggttccggcgatcggattccggtcgacccttaatcaagtgcaatgattgtggagcaaggttcattgaggccaagtgcaacaaaaccctagatgagtggctagccatgaaggattggcccttgtacaagttgctcgtctctcaccaagtcattggcccagaactatctttttctcctcctgttttgttccaggtgactaaatttaagtgcggcggaatttcattgggtcttagttgggcccacgtattgggggatcctctttcggcttcagaattcattaactcttggggtctaatattgaaaaatatgggcctaaaaatgctttttaacatcccaagatccatcccaacacccggacagcccggacctgaaaaggatccagtttcagcaaaacggatcgacccggtgggagatcattggattccagccaacaacaaaaaaatggagacattctccttccacctaactagctcccagttgaactacttgcaagcacaaatttggggtacaagtcttgaccaaacccctccttttgaatcactatgtgccatgatttggcgttgcatggcccgaattcgaccaggatccgaacccaaaaccgtaactgtgtgtagaagcaacccctataagaggggcaatcatatcattggtaacaaccaagtgatatgcaaggttgatgctgcaagtgaatcctcaattcttgacactgatttgacagttttagctagcatgcttgtggatcaaggtgtggatgagaggaagcaaattgaggaagcagttgagagagaccaaggtgtgagtgatttcttcgtctatggtgtcaacttgacatttctagacttacaagaaaccaatgtgtatgacttgcaattgaagggacacacaccaaagtttgtttactacacccttcaaggtgttggagatgaaggggttgttttggtgtatccattgcccaaaggttctatggagaatggtgttgatgggaagtttctgaccatgatttttccggaggatgaaatggtgaagcttaaatctgagctcaagataattggtcttttgcttgagaataattaa

SEQ ID NO: 3594 - DNA, 420 bp, Glycine Max
atggtgaaaaaaagaacgagatcaaaattcataccagcatcatcatcatttatcattctcttttcagcaaccatgaaatcttcaggagcattagctacccttgtgcttctgatcctacttctcgccacaacttcagaggctgcaatttcatgcagtgatgtgatcaaggacttgaggccatgtgtgagctacttggtgagtggcagtggacagccaccagctgcttgttgctcaggagctaaagctcttgcctctgctgcaacaacctcagaggacaagaaggctgcttgcaactgcatcaaatccacttccaagagtatcaacattaactcacaactggctcaggctcttccggggaactgtggaataacccttcctgtggctatctctcccaatgctgattgttccaaggttggttga

SEQ ID NO: 3595 - DNA, 963 bp, Glycine Max
atggtgaaaatctcacttggtggatacgatgatggggaaggacccagcaaccgaacccataagcgacgcagggaagatgatgatgacgacgacgaagaagagcaacaacaacaacgaagctttgagatggtggacccttcaataggaactcaagagaacgaagatcatgctgctccatccaatgatggatcgaattctaacggaaatggggctggaaccagtacccgggataggtccgttcctatcttcgtttccgaccctgatgtccttgattgctgcatttgctatgaacccttgacttcccctgtgttccagtgtgagaatggacatattgcttgctctatttgctgtgtgagactcagtaacaagtgtcccatgtgttcaatgcccattgggtataaccgttgccgggctattgagaaggtcttggagtgtattaaaatgtcatgcccgaatgcaaattatggctgcaaagagacacttagttacagcaagaaaaacgaacatgagaaggaatgcatctatctgccatgttcatgcccttttactggttgtgattttattgcctcatccaaggagttattcctccactttagccatagacatgtaggctctggaacacagtttacatatgataaatttttcactgtcttcttaagtattaaccagagaacagttgttcttaaagagaaaagtgatggtaatctgttcgttgttcacaataacctcgagcatctggggaacatagtccgcattagctgcattggtcccaagtccacgacagagtttcagtatgaagtcttggctaggcatcaaggaaacgctttgattctacaatcttttaccaagattgtgcaagggcaatatactgatgctccatctagtacgttccttttgattccgtcttgtttgtttggctctccacatctgaaactggatattcgcataaagtcacaccattaa

SEQ ID NO: 3596 - DNA, 195 bp, Glycine Max; identical to SEQ ID NO: 494

SEQ ID NO: 3597 - DNA, 318 bp, Glycine Max
atggtgaacgttccgaagacaaagaagacctactgcaagagcaaggagtgcaggaagcacacgctccacaaggtcacccaatacaagaagggcaaggacagcatcgccgctcagggaaaacgccgttatgaccgcaaacagtccggttacggtggccagactaagcctgttttccacaaaaaggccaaaaccaccaagaaaattgtgttgaggctccagtgtcagggatgcaagcatgtctcgcagcacgctatcaagaggtgcaagcattttgagatcggtggtgacaagaagggaaaaggaacctctctgttctag

SEQ ID NO: 3598 - DNA, 339 bp, Glycine Max
atggtgaagggtcgtcaaggagagcgcgtcagactctacgtgaggggtacaatccttggatacaaaaggtccaagtccaaccagtacccaaacacatccctgatccaaattgagggagtgaacaccaaagaagaagtaggatggtatgctggcaagaaaatggcctatatctacaaggctaaggtgaaaaaggatggaagccattaccgctgcatatggggcaaggttacgaggcctcacggcaacagtggtgttgtccgtgcaaaattcaagtcaaaccttccacccagatcgatgggagctcgagtaagagtattcatgtatccaagtaatatatga

SEQ ID NO: 3599 - DNA, 339 bp, Glycine Max; identical to SEQ ID NO: 3598

SEQ ID NO: 3600 - DNA, 546 bp, Glycine Max
atggtgaagtactcaagggagcctgacaatccaactaagtcttgcaaggctagaggcgccgaccttagggttcattttaagaacacaagggaaactgcctttgcaatcaggaagttgcccttggtcaaggctaaaaggtacttggaagatgttcttgcccacaagcaggcaattccattcagacgtttttgtcgaggtgttggaaggacagcccaggctaagaatagacactctaatggccaaggacggtggcctgtcaagtcagcaaaattcattcttgatttgctcaaaaatgctgagagcaatgctgaagtgaaaggtttggatgttgatgcactgtacatttcgcatatccaagtcaatcaagcacagaagcaaagacgccgaacataccgagcccatggaagaatcaatccttatatgtcatctccgtgccacatagagttaatattatctgaaaaagaagaacctgtgaagaaggagcccgagactaagttaacaacaagcaagaaatcccaagctcttcgaagtggcgcttcgtcatag

SEQ ID NO: 3601 - DNA, 570 bp, Glycine Max
atggtgaagtactcaagggagcctgacaatccaactaagtcttgcaaggctagaggcgccgaccttagggttcattttaagaatagcctgatgaaaaaagcagagaacacaagggaaactgcctttgcaatcaggaagttgcccttggtcaaggctaaaaggtacttggaagatgttcttgcccacaagcaggcaattccattcagacgtttttgtcgaggtgttggaaggacagcccaggctaagaatagacactctaatggccaaggacggtggcctgtcaagtcagcaaaattcattcttgatttgctcaaaaatgctgagagcaatgctgaagtgaaaggtttggatgttgatgcactgtacatttcgcatatccaagtcaatcaagcacagaagcaaagacgccgaacataccgagcccatggaagaatcaatccttatatgtcatctccgtgccacatagagttaatattatctgaaaaagaagaacctgtgaagaaggagcccgagactaagttaacaacaagcaagaaatcccaagctcttcgaagtggcgcttcgtcatag

SEQ ID NO: 3602 - DNA, 408 bp, Glycine Max
atggtgaagttccttaagcccaacaaggctgtcatcgtcctgcagggccgctacgccgggcgcaaggcggtgatcgtgaggaccttcgacgagggaaccagggagcgcccctacggccactgcctcgtcgccggaatcaagaagtaccccagcaaggtcatcaagaaggactccgccaagaagacggccaagaaatctagggttaaggcgttcgtgaagctcgtgaactaccagcacctcatgcccacgcgttacacgttcgacgtggatctcaaggatgctgttacccctgatgttctcggcaccaaggacaagaaggtcactgctctcaaggagaccaagaagcggttggaggagaggttcaagaccggcaagaataggtggttctttaccaaactcagattctga

SEQ ID NO: 3603 - DNA, 963 bp, Glycine Max
atggtgacgtttagggttttgcacaatctgaccaaggagttggaccaccttgattgtagtaagaaaaagggtaaagttggtggtgttaatgatgattatgtgagcaaggacaaggaggtgttgctgagtgttgacatggctttggagccgaaatctattttgcgacctagggttaaggttcccaaggatcagattaaggaagcatgcagaccttggaagaaggcaattgttgtgaagttgttaaggaaaaaactgagtatgagatttctgagagttaggttacccaagctttggcaacctttgggtgagatggagatgatagacctggagagtgactattttctcattaggttctatgttttatcggacttgtgcttcatggtaaaggacctacagattgagtactatgtgaaatttattatggattcgaatatgttgcgagcaaagaaggatatggaattagggaattatgtgacgaagagggcaaaatttgctaggatttgtattgaggttgatttgaacatggtgtttcctttacaatttgagttgaatagtagagtttatagtgcaaaatataggcacaaaaagaagtatgcctcttggaaggccatgagattaatggtgtgggagttgggagctctattatgtcatttcaaaaaggatagaaagggggctttggatttaggtttgaagttcttcaagaggatgataatgatggtttacctaatcagagagcacatagggataatgctaataagaaagataagaacaattttagtgattgaagatttattaagatctgttatattttttttctttagtggtagatctcattttgagatcttagacaatttttttctccttcttcctccctccccctctctgttcttcctcccgcaacctccattgaactcaaggtattttttttcgttcttcctcttctgttcttgcatttttgttctt

SEQ ID NO: 3604 - DNA, 3201 bp, Glycine Max
atggtgaggtttttagggttgactcttggttatgctgaagaaccccgtgaaatagcatcgaggtcgaacctgaccagtgattctggtgaaaatgggtggctcatcaggttctttgactcggcattcttctgcgagtggattgctgttagctacttgtacaagcatgatcatgccggggtgcgtgattatctctgtaatagaatgtatactcttcctttgcaaggtgttgagagttatttgttccagatatgttacatgatgatacacaagcctagtccctccttggataagtatgtgatagacgtgtgctcgaagtcgcttaagattgctttgaaggtgcattggttcttgatggcggaacttgaggactctgatgataatgaagggattagtgggattcagaagaagtgtcagattgctgccaccttgatgggtgagtggccacctctaatacggcccctaactgaacccccgagtcccggaggcaaaagccaagttttgaataggttactgtcgtcgaaaaatctcttgttgtcactaacatcctcaccacctgctcaaaagcctttatcattttcaccgtcctcaggaaacaatttgcaagaggatgacaaaccactttctcctgatgagaataagatattcaagaagtttatgccgagcccgaaggttagagatgctttgctttttcggaagtcagtggacaaagacgatgatggttcagaaaaggatggttttttcaagaggcttttgagagatagcaaaggtgatgatgaactgggccaaaaaattcgtgattcatttctgtttaggaagtcgtctgtgaaagatgatgaagactctgaaaaagagaatttctttaaaaggttcttaagggacagtagaggtgacgatgaagactcggaaaaagatggtttctttcgaaggctcttaagggatagtagaagcgaagatgaagatgtagcttcaagttcagagggattatttaagaggttgtttcgtgacagcaagaatgattctgaggacagaacacgtactaaaacaatagaagatgaagataaagagggatttttccgaaagtttttccgggagaaatctgaagataggaaggatgggagtcataggaatgataatagagatgtggctaattttgaagagaaatatgccaaacctgctgaagaggatgaaaaagaagggtttttccggaaattatttaaggataaatctgaggacaagaaagatacaaatgataaaattgaagagggtactgccaatggtgaggaagaagagtcttctgagttttccttgttcagaagactatttcgcgtgcaccctgaagaggctaaaagtagtctgttcaatgaaaacagtaataatggcggtttatttgaaagtagtccaggtacagagaattttttccgtaaattgttcagagaccgtgaccgttcaattgaagattcagagctattgggttcaaaaagacagaaagagaagcatcctggatccccaaagcagcagagtgaaaagtcgagcacaaagcctccattaccaattagtttgtctcagttccggaaaggggcttatcatgactcattggagtttgtgcagtcattatgtgatacatcatatgggttagtggatgtatttcccattgaagatcgcaaaagtgctcttcgtgaggcacttgtagaaatcaatctacatgtagcagaggttcagaacactggaggagtttgttttccattgggaaagggcatgtatcgtgtgcttaatatacctgaagatgaagctgttctcttgaattctagggagaaggcaccttacctgatctgtgtagaggttttgagatgtgaaatgccaagtaattccaaggaggcatccagttctcagaaactttctcaagggggaatccctttggcaaatggagatgctctcatgcaaaaaccacctccttgggcttatccattacggacagcacaagaggtgtaccgcaatagcaacgataggatccagaggagattgaagtggccgatctacacggtggcaggtgtgtatgatgcagcagctgcaggacatgtcagtgatttggaatgggtacgagtagtgttgacagccgatcctggggttagattggaagatattgaggatcaagcaccgcctcggaggaaggaacatcgccgtgttccaagtacggtggcaatagaggaagtaaaggctgcggcagctaaaggggaagcacctcttggactccctttgaaaggtgctggtcaagattcatccgatgcacaaccaagggttaatggaattactcccaaagccagcgatgccttgtctggtgaactttgggaggcaaagaaggataggatatgcaaggcttccatatatgggaagttacctggttgggacttgcgatctgttattgtaaagagtggtgatgattgcaggcaggagcatctggctgttcaacttatttctcacttctatgatattttccaagaagctggcctacccctctggctgcgcccatatgaagttttgtgtacttcatcttacacagctcttattgaaacaattccagatacggcttctctacactctatcaaaagtagatatcccaacatctcaagtttacgtgaattcttcaatgctaagtatcaagaaaattctcccagttttaaacttgcccagagaaactttgttgaaagtatggcaggatattccctggtgtgctactttctgcaggtgaaggataggcataatgggaacctcctattggatgaagaaggtcatatcatacatatcgattttggcttcatgctttccaattcacctggtggtgttaactttgaaagtgcacctttcaaattaacacgtgaacttcttgaggttatggattctgatgctgagggtgttccaagcgagttctttgattattttaaggttttatgcattcaaggcttccttacttgccgcaagcatgctgagcgcatcattcttcttgttgagatgttgcaggattcagatttcccatgctttaaaggtggtgctcggacaatacagaacctacgaaagcgattccatctcagtttaactgaagagcaatgtgtctccttggtgctttcactcattagcagcagcctggatgcttggaggacacggcagtatgattattatcagagggttttgaatggaatattatga

SEQ ID NO: 3605 - DNA, 1167 bp, Glycine Max
atggtgagtgttgaagagatccgtcaggcacaacgtgcagaaggccctgccactgtcatggctattggcaccgccactcctcccaactgcgtggatcagagtacctatcctgactattatttccgcatcaccaacagcgagcacatgaccgagctcaaagaaaaattcaaacgcatgtgtgataagtcgatgattaagaagcgatacatgtacttaaacgaagagatcctgaaggagaatcccagtgtttgtgcatatatggcaccttcgttggatgcaaggcaagacatggtggttatggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgtccctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacattccgcggcccaactgacacccatcttgatagccttgtgggtcaagccttgtttggagatggtgcagccgctgtcattgttggatcagaccccttaccagttgaaaagcctttgtttcagcttgtctggactgcccagacaatccttccagacagtgaaggggctattgatggacaccttcgcgaagttggtctcactttccatctcctcaaggatgttcctggactcatctccaagaatattgagaaggccttggttgaagccttccaacccttgggaatctccgattacaattctatcttctggattgcacaccctggtggacccgcaattttggaccaagtggaggctaagttaggcttgaagcctgaaaaaatggaagctactaggcatgtgctcagcgagtatggtaacatgtcaagtgcatgtgtgctattcatcttggatcaaatgcggaagaaatcaatagaaaatggacttggcacaaccggcgaaggccttgactggggtgtgctatttggtttcggtcctggactcactgttgagactgttgtactccgcagtgtcactgtctaa

SEQ ID NO: 3606 - DNA, 663 bp, Glycine Max
atggtgagtgttgaagagattcgtaaggcgcaacgtgcagaaggccctgccactgtcatggctattggcaccgccactcctcccaactgcgtggatcagagtacctatcctgactattatttccgcatcaccaacagcgagcacatgaccgagctcaaagaaaaattcaaacgcatgtgtgataagtcgatgattaagaagcgatacatgtacttaaacgaagagatcctgaaggagaatcccagtgtttgtgcatatatggcaccttcgttggatgcaaggcaagacatggtggttatggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgtccctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacattccgcggcccaactgacacccatcttgatagccttgtgggtcaagccttgtttggagatggtgcagccgct

SEQ ID NO: 3607 - DNA, 1167 bp, Glycine Max
atggtgagtgttgaagagattcgtaaggcgcaacgtgcagaaggccctgccactgtcatggctattggcaccgccactcctcccaactgcgtggatcagagtacctatcctgactattatttccgcatcaccaacagcgagcacatgaccgagctcaaagaaaaattcaagcgcatgtgtgataagtcgatgattaagaagcgatacatgtacttaaacgaagagatcctgaaagagaatccgagtgtttgtgcttacatggcaccttcgttggatgcaaggcaagacatggtggttgtggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgcccctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacatttcgcggcccaactgacacccatcttgatagccttgtgggtcaagccttgtttggagatggtgcagccgctgtcattgttggatcagaccccttaccagttgaaaagcctttgtttcagcttgtctggactgcccagacaatccttccagacagtgaaggggctattgatggacaccttcgcgaagttggtctcactttccatctcctcaaggatgttcctggactcatctccaagaatattgagaaggccttggttgaagccttccaacccttgggaatctccgattacaattctatcttctggattgcacaccctggtggacccgcaattttggaccaagttgaggctaagttaggcctgaagcctgaaaaaatggaagctactagacatgtgctcagcgagtatggtaacatgtcaagtgcatgcgtgctattcatcttggatcaaatgaggaagaaatcaatagaaaatggacttggcacaaccggtgaaggtcttgactggggtgtgctatttggtttcggccctggactcaccgttgagactgttgtgctccgcagtgtcactctctga

SEQ ID NO: 3608 - DNA, 1167 bp, Glycine Max
atggtgagtgttgaagcaatccgtaaggcacaacgtgcagaaggccctgccaccgtcatggccatcggcactgccactcctccaaactgcgtcgatcagagtacttatcctgactattatttccgcatcaccaacagtgagcacatgactgagctcaaagaaaagttcaagcgcatgtgtgataagtcgatgattaagaagctatacatgtacttaaacgaagagatcctgaaggagaatcccagtgtttgtgcatatatggcaccttcgttggatgcaaggcaagacatggtggttgtggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgtccctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacattccgcggcccaactgacacccatcttgatagccttgtgggtcaagccttgtttggagatggtgcagccgctgtcattgttggatcagaccccttaccagttgaaaagcctttgtttcagcttatctggactgcccaaacaatccttccagacagtgaaggggctattgatggccaccttcgcgaagttggactcactttccatctcctcaaggatgttcctggactcatctctaagaatattgagaaggccttggttgaagccttccaacccttgggaatctccgattacaattctatcttctggattgcacaccctggtggacccgcaattttggaccaagttgaggctaagttaggcttgaagcctgaaaaaatggaagctactagacatgtgctcagcgagtatggtaacatgtcaagtgcatgtgtgctattcatcttggatcaaatgaggaagaaatcaatagaaaatggacttggcacaaccggtgaaggccttgactggggtgtgctatttggtttcggccctggactcaccgttgagactgttgtgctccgcagtgtcactgtctaa

SEQ ID NO: 3609 - DNA, 2064 bp, Glycine Max; identical to SEQ ID NO: 495

SEQ ID NO: 3610 - DNA, 1839 bp, Glycine Max
atggtgatggctaacggggttgttacaccagcaatgtcagtactatcatctcttaatggtttgaaagttggggtagatgcaattaagcaagatgaagtggtgatgatttctgttgcctgccttgtcattttgttcagtgtacagaagtatggaacaagtaaagtggggcttgctgtaggacctgctttgtttatatggttttgttctcttgcgggcattggtatatacaaccttgtcaaatatgacagcagtgtcttgagggcatttaatcctattcatatatattatttctttgcaaggaatccaaccaaggcatggtattctcttgggggctgtcttctgtgtgcaactggctctgaggctatgtttgcagatctttgctatttctctgtacgatcagttcagcttacatttgtatttcttgttttaccgtgcctactgttgggttatttgggtcaagctgcataccttatggaaaaccatgctgatgctggtaatgccttttattcttctgttccaagtggtgcattctggccaactttcctcgttgctaacattgctgcattaattgcaagtcgtgctatgacaacagccacattttcttgtataaaacagtcagctgcacttggttgtttccctcgtcttaaaataattcatacctctcggaaattcatgggccagatctatattcctgtcataaactggtttctcttggctgtttctttggtgcttgtctgttctatatccagcattgatgagattggaaatgcatatggcattgctgagctgggggtgatgatgatgaccactattttagtaactcttgttatgcttcttatatggcagatacacatcattgtagtgctgagttttgcggtagtcttcctgggattggagttgactttcttttcatcagttttgtggagtgtaacagatggaagttggattatattggtctttgctgtaataatgttttttataatgtttgtatggaattatgggagcaagctcaagtatgaaactgaagtaaagcaaaagctgtcaatggatttgatgcaagaattaggctgcaatcttgggacaatacgagctcctgggattggtttgctctataatgagttggtaaaaggaattccaggcatttttgggcattttctaaccacacttccagcaatacactctatgatcatatttgtgagtattaagtatgttccagttcccatggtgcctcaaagtgaaaggttcctttttcggcgagtttgccagagaagctatcatatatttcgctgtattgccaggtatggttacaaagatgttcgcaaagaaaatcaccaaacttttgagcaactgctgatggagagcctagagaagtttatacgtcgtgaggctcaagagaggtcgcttgagagtgaaggggatgacgatactgactctgaggatgagtactctggttctagggttctcatagctcccaatgggagtgtttattcacttggtgttcctcttctggctgattttaatgatacaaccatacccatacccaattttgaagcaagcacatcggaggagacaaaccttgaatctcctaagcccgcagtggttgatgctgagcagagtcttgaaagagagctatcttttatacgcaaggctaaagaatctggagttgtttatcttcttggtcacggagatataagagcaagaaaagactcatggtttatcaagaagctaattataaactatttttatgcctttctgagaaagaattgccgaagggggatcacaaatttaagtgtaccccattcacatttgatgcaggttggcatgacctacatggtttga

SEQ ID NO: 3611 - DNA, 2970 bp, Glycine Max
atggtgcagtctagtgttcccctctgcaacacttgtggggaacaagtgggacttaatgataatggggaagtgtttgtggcttgtcatgaatgcaatttcccaatttgcaaggattgttttgagcatgagatcaatgaggaccatagggtctgcatgaggtgtggcactccctatgaagagagaacaaaggaggaggatgatttccatgagataaaggttcacgaaaatgaggatgatgatttccatgagataaaggttcatgaaaatcaatccgcaacaccttccgaaatcagtaactctcaggatgttggactccatgctagacatgtcagtacagtatccgcagtcgatagtgaagtaaatgaagaatctggaaaatcaatctggaaaaatagagtggaaagctggaagggaaaggataaaaagaacaagaagaaaaagtctgcacccaaggaagaaaaggaggcctcaattcctccagagcagcagatggaagaaacacggcccgcagaggctgctgctgcaccactttcagtagttattccaatgtcaaaatccaaaattgcaccgtacagaactgtgataatcatgcgattgataatattgggacttttcttccattatcgagttacaaacccagttgaaagtgcttttcctctttggttgacttctatcatctgtgagatctggtttgcattttcctgggtgctagatcagttccctaaatggagtcctatcaataggcaaacttttattgacaatttgtctgcaaggtttgaaagagagggtgaacccaatgaacttgctgctgttgatttctttgtcagtacagtggatcctttgaaagagccaccattgatcacagctaatacagtgctttctatccttgcggttgactatccagtagataaagtatcctgttatgtgtcagatgatggtgctgcaatgctcacatttgaatctcttgtggagactgctgactttgcaaggaagtgggtgccattttgcaagaagttttcaattgaaccaagagcaccagagttttacttctctcagaagattgattacctgaaggacaaggtgcaaccttcttttgtgaaggagcgtagagcaatgaagagagactatgaagagtataaagtacgagttaatgctatggtagctaaggctcagaaaacaccagaagaaggatggaccatgcaagatggtacaccttggccgggaaataactcacgtgatcaccctggcatgattcaggtttttcttgggcacactggtgcccgtgacatagaaggaaatgaacttcccagattggtttatgtttccagagagaaaagaccaggttaccaacatcacaagaaagctggtgctgaaaatgcactggtgagagtgtctgcagttctcacaaatgctcccttcattctcaatcttgattgtgatcattatgttaacaacagcaaggccgttcgggaagcaatgtgttttctcatggatccagaagttggtagagatgtgtgttatgtgcagttcccccagagatttgacggtattgatcgcagtgatcgatatgccaatcgcaacacagttttctttgatgttaacatgaaaggacttgatggcattcaaggaccagtatatgtgggaactggatgtgttttcaatagacaagcactttatggctatagccctccttctatgcccagcgtaccaagatcttcatgctgttgcttcccctcaaagaagtccaccaacgatgtctcagactttcaaagaaacgcaaagagggaagaacttgaggccgccatttttaatctcaaggaacttgacaattacgatgagcatgagaggtcaatgcttatttcacaaatgagctttgaaaaaacttttggcttgtctactgttttcattgaatcaacactaatggagaatggaggagtgcctgaatctgcagatccctcgatgctgatcaaggaggccattcatgtaattagctgtggatatgaagaaaagactttatggggaaaagagattggttggatttatggttcagtcactgaggatatcttatcggggttcaagatgcaatgtcgaggatggaagtcaatatactgcatgcccttgaggcctgcattcaaagggtctgcacctatcaacttgtctgatagattgcaccaagtccttcgatgggcccttggatcaattgaaattttcctaagtaggcactgccccctctggtatggattttctggaggccgtctcaaatggctacaaagaatggcttatataaacaccattgtctaccctttcacatcccttcctctcattgcttactgttctctgcctgcaatttgcctcctcacaggaaaatttatcataccaacgctttccaacgttgcaagtgttctctttcttggacttttcctctcaattataataaccagtgtgctggagctgcgttggagtggtgttagtatcgaagatctgtggcgtaatgagcagttctgggttattggaggtgtttcagcccatctgtttgccgtgttccaaggacttcttaagatgttggctggtgttgacaccaacttcactgtcactgctaaggctgcagaggacagtgagtttggggaactttaccttgtaaagtggaccactctcttgattcctccaacaacccttatcgttgttaacatggttggtgttgttgctggattctctgatgcacttaatggagggtatgagtcttggggacccctctttgggaaagttttctttgctttctgggtgatttttcatctctatccattcctcaaaggtctcatgggtcgccaaaaccgcacaccgaccattgttattctctggtcagtgttgttggcctctgtcttctctcttatttgggtcaagataaatccatttgtcaacacagttgacagtgaaaccatcgccgagacctgcattgccatagattgttaa

SEQ ID NO: 3612 - DNA, 216 bp, Glycine Max; identical to SEQ ID NO: 496

SEQ ID NO: 3613 - DNA, 1203 bp, Glycine Max
atggtgcctcctcatggaaaaggagcgttgtacattaggcctttattatttggaagtggatctgttatgggtattgcacctgcaccacattgcaccttcctaatatacactaatccaatttccaacgcttacaaatgcagggttgagttcaaaacaggagccgacactgtgacccagaatactgctggggaaaactatgctgacattaattgggatgagcttggatttagtctagttccaacagattacatgtatgtcatgaaatgtgcaaagggagataagttttcacaaggatccatccttccctatggaaacttagagattaacccttctgctggaatcttaaattatgggcagggaatctttgagggactaaaggcatatagaactgaagatgggtgcatccttctgtttagaccagaagagaatgctcaacgaatgaagataggagcagacagattgtgcatgccatccccatccattgaccagtttgttgctgctgtgaagcagacagttcttgccaacaaacgttgggtgcctccaccagggaaagggtcactatatattaggccattgctcatgggaaccggagcttctttgaacttgtctccagcacctgagtacacattacttatttattgttctcctgtcactaattaccacaagggttcactgaacttaaaagtggagagtaagttctaccgagcaatatctggcactggtggaaccggagggatcaagagtgttaccaactatgcccctgtttatgctgcaagcattgaagcaaaggccagtggattctctgatgttttgttcttggactcagcaactggaaaaaatatagaggaggtttctgcatgcaatgtgtttgttgtgaagggtaatgctatctgcaccccggcaacaaatggagccatcctccctgggatcacacgaaaatccatcattgagattgccttagatatgggttatcaggtcacggaacgtgccatatcagtggaggaaatgctagatgctgatgaagtgttctgcacaggaactgcagttgttgtcaactctgtttcatctgtaacctacaaagaaacaagaactgagtataaaacaggaccagaaacattgtcccaaaaactgcgcaaaacactggttggaattcaaactgggtgtattgaggacacaaagggctggacagttcgaatagattga

SEQ ID NO: 3614 - DNA, 1092 bp, Glycine Max
atggtgcttccgcaagatttgataactgaaatcctgttaagattgccggtgaagtctctagttcgtttcaagagcgtgtgcaagtcatggctttttctgatatctgatccccgctttgcaaaatcacattttgaactagctgcagcacttgcagatagaattttgttcattgcatcttctgctcctgaactccggtccatagacttcaacgcatcacttcatgatgactctgcctctgttgcagtaacggtggaccttcctgcccccaaaccctattttcactttgttgaaataataggttcctgcagaggctttatacttttgcactgtttatcccatctttgtgtgtggaatccaaccactggtgtccacaaagttgtacctttgtcacctatttttttcaataaggatgcggtgttttttacgcttctttgtggttttggatatgacccatcaacggatgattacttggtggttcatgcatgctacaacccaaaacatcaagcaaactgcgccgagattttctcactcagagctaatgcgtggaaaggaattgagggcatccattttccttatacccattttcgttataccaacagatataaccaatttgggtcgttcttgaatggtgctattcattggttggcttttcgcattaatgcatcaattaatgttattgttgcctttgatttggtggaaagaagtttttcagagatgcatctgccagttgaatttgattatggcaaacttaatttttgtcatttgggggtacttggagaaccgcctagtctatatgctgttgtggggtacaaccattcaatagaaatgtgggcaatgaaagaatacaaagtgcagtcgtcttggactaagagtattgttatttctgttgatggctttgctattcggtccttctttccggtatgctctacaaaaagtggtgatattgttggaacaaatgtcatacctggattgatgaaatgtaatgacaagggagaactgcaagaacttcgaacctactgtgatagtccatatccatccgaggtggctgtgtatacagagtctctattttcactcccttgtgatagtaagtga

SEQ ID NO: 3615 - DNA, 1170 bp, Glycine Max; identical to SEQ ID NO: 497

SEQ ID NO: 3616 - DNA, 129 bp, Glycine Max; identical to SEQ ID NO: 498

SEQ ID NO: 3617 - DNA, 882 bp, Glycine Max
atggtggcgagaggcgtgccggcgatggcggtggtggccgttgccgcccttgacttgacggaatcctccaactggtggcgggacatcaaccgctccccgctctggcaggatcgcatcttccacctcctctccatcctctacggaatcgtcgccgccgtcgctctagttcaattagttcgaatacaatggagagtgccggagtatggttggaccacgcagaaggtctttcactttctcaatttcattgtgaatggggttcggtgttttgtttttgtcttccgtcgggatgtgcagaagttgcagccagagattgtccaacatatcttacttgacatgcctagtcttgctttctttacaacttatgcgctgttggtactgttctgggctgagatttattaccaggcacgtgccgtatctactgatggtctcagaccaagtttctatacgattaatgctgtggtttatgttattcagattactttatggttaatattatggtggaaacctatcagcgtgctagtcatcctgtctaagatgttctttgcaggggtttctttgtttgcagcccttggttttcttctttacggtggaagactattcttgatgctgcaacgctttcctgttgaatccaaaggtcgacgcaagaagctacaagaggttggctatgtgactaccatatgcttttcatgcttccttatcagatgtgttatgatgtgctttaatgcatttgataaagctgccgaccttgatgtcttgtaccatcccattctgaattttatgtattacctgttggtggaaatattgccttctactttggtccttttcattttgaggaagcttcctcccaagcgtggtatcactcaatatcacccaattcgctga

SEQ ID NO: 3618 - DNA, 882 bp, Glycine Max; identical to SEQ ID NO: 3617

SEQ ID NO: 3619 - DNA, 1278 bp, Glycine Max
atggtggtcagaagctccaaagcagctcgtctcataatggtttacttggatgccagccattcagataccagcatggaggagattcagaaggatttgtctccgttggttacacagttggcacctgcagaaaatgggaatggagctaaaatacctttcatgatggcaagtgaggggatcaaggagcgaaacatcattcataaggtcacatcttcattaactggatcaattattgttgaagatgtaatttatgaaaatgttgatagtgaagtcagttgtatttttccttctggagagttgatgtttcgacgccttgtattcgagagagctgcaaatttggtgcagtctgaagctttgctaaaagatgaacagttgcctaccaaattggttagtgagacagggaagaagaaaaacaatgcatcttccaaatctaggaaaagtggatcttggagagacagtgttggagcaagcagtcagttgactgtctatcatggctatgtagctagttcttatcatacagggattatttcaggattcatgctaatatcttctcacatggaaaatgtggcatcaagtgggaaaatggtaaaagctgtaataataggtcttggagcaggtttacttcccatgtttcttcacggatgtatcccctttttggaaattgagactgtggagttagaccccatgattgttgatattgcaagggactacttcagttttgttgaggataaacatgtaaaggtgcatatagctgatgggatccagtttgtccgggagattgacagttctggagcagctcagattcatggaaaaagtaatgatcctagctatacagataccgctttaaatgcaagttcagctgtgtctcatgctgatgtagaagtgacaaaagttgatataattattgttgatgttgactcttcagacccaagctcgggattgacatgccctgctccggattttttggatgagtcttttcttgagactgtaaaggatagactttcagaggatggtctctttgttgtcaatttggtgtcacggtcccaagccattaaagatatggctctctcaaaaatgaaaaaggttttcagccacctcttctgcctccagcttgacgaggacgtcaatgaggttcattttgccctcaaatctgagtcctgtattgaggatagctgtttctccgaagcttctcttaaacttgataaattgttggagttcaaacacccggagataggtcaaaacattatcaatgcgacaaaaaagatcagacgtacaatataa

SEQ ID NO: 3620 - DNA, 1632 bp, Glycine Max
atggtggtttcggggccgatcacgccggggcaggtgtctttcttgctgggggttattccagtttttgtttcatggatatattcagagtacttggagtacaagaaaccctcatctcctcccaaagttcattcagatgtttgtcttgaagagttggggaaggatgcaattaaggaagatgatcgggccattttgctggaatcagggcttacaagatcagcatcagcaaaattccatccatcatctgtcaaattgaatttgattcggtttttgaccatggatgattctttcttgttagaaaatcgagcaactttgagggcaatggctgaatttgggctgattctgttttatttctacatatgtgatcgaaccaacatacttggagattccaccaagagttatagtcgggatcttttcatcttcctctaccttcttctgattatagtttcagctttgagttctttgaagaaacataatgactcatcaacattttctggaaaaaatatactttaccttaaccgacatcaaacagaggagtggaaaggatggatgcaggtcctctttttaatgtatcattattttgctgcaacggagatatacaatgcaatacgtgttttcattgctgcatatgtttggatgactggatttggaaacttctcctattattatatcagaaaagattttagccttccacgttttgctcagatgatgtggcggcttaatttttttgtggccttctgttgtattgtgcttaacaatgactatatgctctactatatatgcccaatgcacacgcttttcactttgatggtgtatggagcattgggtatatataacaagtataatgaagttccctctgtgatggctgcaaagattttggcatgctttcttgtggtgatcttggtttgggaaatccctggattctttgacatattttggagcccatttgctttatttttgggttatactgatcctgcaaagcctgatctccctcgaatgcatgagtggcatttcagatctgggcttgatcgctacatctggataattggaatgatttatgcctactttcatccaaatgttgagaaatggatggaaaaattggaagagagtgagatcaagaggagagctaccatcaaaaccagcattgtttctgttgcattatttgttgggtacttgtggtatgaatacatatacaagctggataaggtctcatacaacaagctccacccctacacctcatggattccaattactgtatacatttgcttgaggaatttcagtcagcggcttcggaatttctctttaaccctctttgcgtggcttggcaagattactttggagacatacatttcccagtttcatatttggttaaggtctaacatgccaaacggacagcccaagtggcttctttctcttatcccggagtatcctatgctcaacttcatgctaacaactgctatatacgtctttgtatctcatcgactttttgaattaacaaatacactcaagacagtgttcatacctacgaaagacaatcgaaggctgctgcataattttattactggggttgtactttgcctttctctgtattgcattgcacttattcttcttctgattcctcattcaacggtttaa

SEQ ID NO: 3621 - DNA, 3423 bp, Glycine Max; identical to SEQ ID NO: 499

SEQ ID NO: 3622 - DNA, 1584 bp, Glycine Max
atggtgtcaccaatctcacttattgtcctcttgttatcagtttctttagcagattcagcttcagttcaagaaagttttgtccaatgtctcaacttgaattcggacaaaacatttccattttactcatcaatctacactgcaagcaacccttcattcaccagcatccttgactcctccgcacagaacctaaggcttttggtgccttcagtgccaaaacccgagttcatattcacaccctctcgtgattcccatgttcaagcagcagtaatctgctccaagaaacttgggattcacattagagtgcgaagtggcggccatgactatgagggaatttcgtacgtctccgaaattgagagccccttcatagttgtggatttggtcaagctccgcggcatcgacgttgatgtaaaaagcaacactgcttgggttcaagctggtgccacaactggtgaagtttactacagaatatatgagaagagttcagttcatggtttccctgcaggcctttgcacaagcttaggcattggagggcatatcacaggaggagcatatggagccatgatgagaaaatatggccttggagttgataatgtcttagatgctaaaattgttgatgccaatggaagaattcttgatagagaagccatgggggaagacttattttgggctataagaggaggtggaggtggaagctttggaatccttctttggtggaagataaagcttgtttctgtgccaccaactgtgacagtttttacagttaccaaaacccttgagcaaggtgcaaccaagattcttcacaaatggcaagaagtggcaccttatattgatgaaaacctcttcatcagagtcatcattcagccatctagtgatgcaagaaacaagactcagagaaccatcgcaacttcttacaatgctctcttccttggtggggccagaacactcctccaagtcatgaagacaagttttcctgaattggggttgacaataaaggattgcttggaaactagttggatcaaatctgtgctctatattgcaggctttccaagtgacacccccccagaagttctgctcaaaggaaagtcaacattcaagaacttcttcaaggcaaaatcagattttgtgagggaaccgataccggaaaccgggctcgaggggttgtggcaaaggttgctggttgaagacagccccttgatgatttggaacccatatggtggaaggatgagccagttttcagaatctgagaccccatttcctcacagaaatggaacactatacaaaattcagtacttgtctttgtggcaagagggagacaagaatgctgcaaagcacatagattggattaggaagctttacaactacatgggtccttatgtttctagcttgccaagggaagcatatgtgaattaccgggatcttgatttggggataaacaccaagaacagcacaagttacattcaagcaagtgcttggggttataggtattacaagaacaactttgacaggttggtgaagattaagaccaaagtggatcctgaaaacgtgtttaggcacgagcagagtatcccaccacttccactctga

SEQ ID NO: 3623 - DNA, 162 bp, Glycine Max
atggtgtgccaagcagcgagccaaacaagattccgggcattaaaacatgagtatggcattgatggtaaagcaacaattattgttagagtgatagcatgcttccaacccttgcatttttgtcaggctgagtacttccgtcatttgcttaagcctgtcacgtag

SEQ ID NO: 3624 - DNA, 348 bp, Glycine Max; identical to SEQ ID NO: 500

SEQ ID NO: 3625 - DNA, 603 bp, Glycine Max
atggtgttagcttctctcactattctgcttctgatcttcttcctctgctttcgtaggaagcggaacctggcgacgaaacacagcttagggagcatccctctggtgtccaaggagatcaccatggtcaaggccttggatccgaagaagatggaggaggcgaaggtcaaggttgaaattggtggggcccagcaccaccgaagcagcgaattagttacaccatttgggaagtggaactcgccacacgcgggtttgcaaaaagaaatgttattggggaaggaggctacgccgttgtgtacagaggtgttttgcacgatgcttccgttgtggttgtcaagaatcttctcaacaacaaaatggatatttatccaaaacagaaaaataaaaaagctgaaaagcgcgagagaacgaggtctgaaacttatagcactagcacgcataattgttggagctcctaaccagacgggactcctccctagctccgtccacgcgccgccgtacgctctgaaatcttccgtcgtctccgccatctccgctgccagcctttcgatctggccagattgttgtacgtctgctccaatttgcatttcacttctcaatttatag

SEQ ID NO: 3626 - DNA, 1872 bp, Glycine Max
atggtgttttctgttttctctgcaccctatgttcatcccgaactccaccctattgtagccaaaatgaccctttttgacaccatactcttctatgtgatacattttgtggacaagcttgagttgtggcaaaggctgccagtgttgttggggttagcatacttgggaattagaaggcacttgcattatcgttacaatttgttgcatgctggaggagtcaatggccacaagtatgatacacaagagtatgcctatacgacaccggatggtatgtgcaaccaccctgctgaccatttgatcagcagtcaggggacgtcttttggccggaacatgcctccgacgaccttagattatggtaccaacatccaactactttttctcatgttaataaagttactggaccctcacccaaccgtggtagcctcaaagctcctagaaagaaaaaatttcaaagaggcagggaagcaattcaacatgatagcttgctcatggatgcagctcatgattcatgattggattgaccatttagaggatactgaacaggtggaaattagagctcctgatggttattcaagtggatgtcctttaaaatctttcatgtatttcaagactaagaagttcaaaacagacgcttcatgtatgaagtttggcttccaaaacatcaggactccttggtgggatggaagtgtcatatatgggaataacgagaagggcatgaaaagagcgaggacgttcaaagatggaaagctgaagatctcagaagatgggcttcttgagcatgatgagaaaggtattcctatatctggtgatgttagaaattgctgggctggcttttcccttttgcaggccttgtttgtcaaagagcacaatgccctatgtgatatgctaaaagtgcactatcctgattttgatgatgagcagctctatagaatgcaagattgggatgagaataaacgggtaagtctaaatagatgtaattttggagataagctactttatacaatagcagttttctatgcaactttggtcttaggaagccaggagatcatggagttccctaatcacttactgaagaatttgtcagtgtttacagaatgcattcactgctacctgatgaaattgtccttcgagatatcaagcctacaagaggagaatataaatgccctccaatacttgaaaattaaaagccacttccatatgtgggaaatgagggaacctatgaaggaactgttgggaaaagaaggggaaagaaggctatcaaacttaggaatggagcagatgctagtatccatgggtcatcaatcaagtggtgcagttgacttgtggaactatccaacatggttagggaacctcattgcccatgatattaatggagaagatatacctgatcctgttgacatggctaccatggaagtttatagagatagggaaaggggagttgcaaggtataatgaattcagaagaaacttactaatgatccctattagcaagtgggaggatttaacagatgatgaagaggtcattgaagctcttagagatgtatatgaagatgatgctgaaaagctggacttgatagtgggtctccatgcagagaagaggataagaggctttgctatcagtgagactgctttctttatattcttaatcatggcttggaaagctgatcgtttcttcacaacgaatttcaactccaaaacatacacagataaagggcttgaatgggtaaacaaaacagagactttgaaggatgtgattgacagacactttcctgaaatgactaaaaactggatgaggtcctcaagggcattctgtgtttgggattcaatgccagatcccacaaactacatacctctatatttgagatcagccccataa

SEQ ID NO: 3627 - DNA, 951 bp, Glycine Max
atggttaaaactgttggagttcggttccaccctactggtgttgagttagttgtgtactttctgaagaggaaagtgatgggaaaaaaaatctgcgatggtttcattgctgaacttgacatatacaagtatgctccttgggatctcccagataagtcttgtctgagaactggggaattggaatggtacttcttctgcccgctagagaagaaatatggcagtgggagcaagatgaagcgtgctactgaaattgggtattggaaagctactgggaaggatagagttgttcagcacaataatcgaactgtggggatgataaagacactgatatttcacacgggtaaatcgcctcgtggcgaaagaactgattgggttatgcatgagcataggcttgaagataaggacctcgctgacaaagggattgctcaggattcctatgtagtctgcaaggtattccaaaaggaaggtcttggtcccgggaagggaacacactatgcgagaccatttaatgaggaagagtgggacgatgaagaaattggaataccttgtgctgctttgactgcacaagttcccaccttgcctattacatctgatggttctgttgcaaatgacaatcatctccctgctagtggatgtattgggtcagcatccacatcatgtctatcaggatcagtgccttctctgggcacagtaaatcctactggtccaaatgatcaagctgttaatgatgatattttaccaatgcttcatatttttaatgatgacaaatggtttgaggaaaatattgttgaaggtgcaccaccttcagatgatttttttgcgggcttggaagactactttgctggtttctcctctggccagaatacaggtgatgttgggaactctgatgacttggacttcttagagttgaatgacctagacaccccattattctatccgaccacacaaccttga

SEQ ID NO: 3628 - DNA, 972 bp, Glycine Max
atggttaaaactgttggagttcggttccaccctactggtgttgagttagttgtgtactttctgaagaggaaagtgatgggaaaaaaaatctgcgatggtttcattgctgaacttgacatatacaagtatgctccttgggatctcccagataagtcttgtctgagaactggggaattggaatggtacttcttctgcccgctagagaagaaatatggcagtgggagcaagatgaagcgtgctactgaaattgggtattggaaagctactgggaaggatagagttgttcagcacaataatcgaactgtggggatgataaagacactgatatttcacacgggtaaatcgcctcgtggcgaaagaactgattgggttatgcatgagcataggcttgaagataaggacctcgctgacaaagggattgctcaggattcctatgtagtctgcaaggtattccaaaaggaaggtcttggtcccgggaagggaacacactatgcgagaccatttaatgaggaagagtgggacgatgaagaaattggaataccttgtgctgctttgactgcacaagttcccaccttgcctattacatctgatggttctgttgcaaatgacaatcatctccctgctagtggatgtattgggtcagcatccacatcatgtctatcaggatcagtgccttctctgggcacagtaaatcctactggtccaaatgatcaagctgttaatgatgatattttaccaatgcttcatatttttaatgatgacaaatggtttgaggagatttataatcctggtcaggaaaatattgttgaaggtgcaccaccttcagatgatttttttgcgggcttggaagactactttgctggtttctcctctggccagaatacaggtgatgttgggaactctgatgacttggacttcttagagttgaatgacctagacaccccattattctatccgaccacacaaccttga

SEQ ID NO: 3629 - DNA, 2133 bp, Glycine Max
atggttacccaacaacagccacagccacagcttcaggtccagcccacaccaccctcttcgcaagatgaggccttgaagaggaacaccgattgtgtctacttccttgcatctcctttgacatgcaaaaagggaaatgaatgtgagtaccgccatagtgagtatgcacgtgttaatcctagggactgtcggtattggttgagtggcaattgcttgaatcccaaatgtccatttcgacatccgcctcttgatggcttgttaggaacacaggcaacagcggctggtggaccatctgtacccccatcacagattccaacagcatctgcagcacatgcaccttataattccagtaaacaagctgtcccttgctatttcttccaaaaggggctttgcttaaaaggtgaccgatgtgccttcttgcatggtcctcctgctcctactcctagcactggtaataaagtagctgctcaggttccagtgactattcaaggagccgagaatccaagttttaagaagccttttgtcagcaatgaaaagtatactcaggaaaggaaaacttcccaaggaaattttgcaaagtcaggtggagctcctgaagctaaaccttcccccaaaattgaaactgctcctcaaagaaatatgtttgaattggagaagaaagtgccaccaccatctgcagaattcaataatgaggcttctagatttaagacaatttctccaccagtgaccaatgggcccattgtggcccggtcaaaccgtctgcaccaagctcgtgtgccagatgatcacaatttccagagtggcaaggacagtgatgagtttctcagagaatcatctcctgggtttgatgttcttgtagctgatgaacttaggaattctgattactaccatggggaagatgaattcggtaaagcaagaggtcaagatgaaaggaacttagactctttgaatgaatatgatttaggacattctggtgattatagtttagcagctgatattgatcgagaaagattccgtgggcctcaaggttatgagtcatatgatcacatgcaggagccatatgcttgggagcagcataggaagccctcatcccatttaggcaggaggactcgtcgcagatctgacagtcctgaaaatgctgaggtctcagatcttcgacatcatttatccaagcgcaggaagggtaatggtttgaagtcggttatcagtcatgatcatgcccatgggggccatggtgaggaacagagtcgccggtccttctctcggaaggactcacttgagttaccgctgaatgagagctcccttggtaatcgcttccggggtagaataaaacttccggaaaatggtgacggtgatcacccagagagggaagacgggggaagatttaggaacagattaccttctggaaggttgccagccactcaccatttgtcacctagagagggaagggtccatgacagaataagaggaaggttgcaagatgatgagaggagaaactccaaggatcgattgatggggagagaactaccgggtgataggagtgattttgctgcgccaaaaagtctttctgaacttaaaaatgggaggaacaccgagaatagggagcaacaatcactgggaaggagaagaagtttaagggacgatcacccacaatctgacgatgattttctgtttgaaggtccaaaacctcttagtgaaattctgaaggagaagagaggagctggagctgattcagactctgggaatggcaaatcatctgacaataagaatgtagaagttacccatggctcggatcctatgtctgttgcaaacacacaaaatggagtgctgtctgagaccaaggaagatgacaagaatcttctgctaaataatgaagaatccaagcttgaggtcactgatgcagctggaggagacaatgatggtgaatatgaggagggaatagtgtacaatgaatcgggtgaggatcagtattatgaaggtgatgatcagagagatgcggactatgagtatgaacaaggtgaagagggatactatgagtatgaacaaggtgaagagggtgaaaatcaagaggaagattacatggaagaagaagatggggatgattttgctaagaagattggtgtcgttcattcataa

SEQ ID NO: 3630 - DNA, 1257 bp, Glycine Max; identical to SEQ ID NO: 501

SEQ ID NO: 3631 - DNA, 1347 bp, Glycine Max; identical to SEQ ID NO: 502

SEQ ID NO: 3632 - DNA, 162 bp, Glycine Max
atggttcggactctaaaatcggtggcaaaccaaagactactggatccggtcttgcctatgtcaatagaaatacttgaaatgccaacaactgcatgcaaggggaaaaagattcaaacaaaggtgatcatgtggaagtgggaactatgtatgaagaacttttag

SEQ ID NO: 3633 - DNA, 2547 bp, Glycine Max; identical to SEQ ID NO: 503

SEQ ID NO: 3634 - DNA, 486 bp, Glycine Max
atggttctcagaccatgtttccaggggaagttgttcaaggccccgggttcagtcaattacagaaggttgtttccatttcaaaaggataccgtgagagatgattctgatacaccaaaattgggattttgccagaaagaccaggagggtagacagggattccaactgcctttgtcacctcaaaattatggtgttaaagatgctacaagtgatttgcccgatgatggcttgaagcaattgtctagccacatgaataatcttgattgtgttgaggctagtacctcacaggagtttggtgttttgaatgaagaatgtatacagacaactcctcctgatgctgatatatatgttaattcagaggtcaatgtcaaacccatggattttaccagaagcactcatgaaaatgcgggtcaagggttttgtctgaaagctgacaaggtgaaagattctcttaagagtaaatccgtaagaatctgtccttgtttctaa

SEQ ID NO: 3635 - DNA, 297 bp, Glycine Max
atggttctcgactccattttgtcgtcttctccttgtctgaagtcaccatctttcagtaggcagtttgcaaggcatgaactgggaagttggtcaacactcgtcaagagacactgcttcctcttatctgctcttgctctactaactgtcctctgtaccatttatctatattttgcagttacattcgcagccaatgactcctgctctgggttgagtggatctctgagagattcctgtcatatggagcatgttatggattctgaagccaagagtaaactgaaaggtctgagacatttatga

SEQ ID NO: 3636 - DNA, 297 bp, Glycine Max; identical to SEQ ID NO: 3635

SEQ ID NO: 3637 - DNA, 891 bp, Glycine Max
atggttcttgtcgctttacctttcttggggtttattctgaagggttcagttgtttctggatttgatgctactgctactgaatcaggttccatcatcagtgatgaggtgttgaatttgattctccgtgatttgggcgaggagggtcttctaagaaaggagcataaggttctcattatggactctccacctccacgtgttatggattttgaagtgtcttatgattttgtgttcacctgcagctttgatgctgctgcttttgctgatagtgttttgaaagttaatgggattgtggctttcccattgaggattgacccaacatctaatgctggtatgaaggctactgatgttgcattgaggaaaattgggttggttaatgacttggtggattcttcaccaaagagaaagctttgccaattggcaacacgggttaagagaaatgctttgaagggtcttgaggacgcgcttcttgagccaccgagggatgattttgccaagccaaacaagattaagtacctcctgagttgttgggtgattctcttgaaggttacaagagaggagtcttcattggtgtgggcttgcatgaggaaaatagagctgcggttgaatggtttgagcaggactaccccaaaaagggtgcaatgttttagattcatagtctccaggttgcatcagaaccacatggatgtttccgcatggttaacaaatcatgtgaaggaggaagagtttgttgtgatgaaggctgaagcaggtgtggtgttggagatgatgaggaataagacaatctgcttaacagggaggagaaataagagtggcagaacatattgggagtgcttggctttgtatggaaggctgagggatgagggagttgcagtgcaccaatggtggaattga

SEQ ID NO: 3638 - DNA, 216 bp, Glycine Max
atggttgaaaagaagagatcatggctctctaagaggctcaagagagagtcactgaggtggaagtacctgggtgctgcattcaagtggaagaggctttcctctttgccagtttccttcttcaacaacgtcgctttcaagattctctctctctttgaagccattttcctcgttctcactgcctgctttttctacctcatgtgtggatgccgcttttga

SEQ ID NO: 3639 - DNA, 948 bp, Glycine Max; identical to SEQ ID NO: 504

SEQ ID NO: 3640 - DNA, 720 bp, Glycine Max
atggttgctcagaaattcgttgttgatttgaacaagccccttgtgttccaggttgggcatcttggggaagcctatgatgagtgggttcacgatcctatcgtaagcaaggaaggccctcggtttttccaaaatggttttctcgagttgttcacgcgcaccgcgtggtgggtgattccaaccgtttgggtgccggttgcaagttggttcatttccaactccgtaaaatcaggcctcccttctcttgatgtagctctgctcgtctttcttggcatcttcgtttggactttggccgaatacacattgcaccgtttcctcttccatgtcaaaaccaagagctactggggaaataccttgcattatcttctccatggctgccaccacaagcaccccatggatagctatagacttgttttcccccctgtagctgcagctatattagccctcccgatctggaacttagtgaagcttatatgcaccccttcggttgctcctgccgtgtttggaggtattttgttgggctatgtgatgtatgattgcacccattactacttacaccatggtcaaccaaagtctgatgtgcccaaaagtcttaagaaatatcacttaaatcatcattatcggctccagaactatggctttgggatcacttcacccctgtgggataaagtttttggaacggttcctcctcctcaatcaaaaggggatgccaaacgtagataa

SEQ ID NO: 3641 - DNA, 618 bp, Glycine Max
atggttgctcagaaattcgttgttgatttgaacaagccccttgtgttccaggttgggcatcttggggaagcctatgatgagtgggttcacgatcctatcgtaagcaaggaaggccctcggtttttccaaaatggttttctcgagttgttcacgcgcaccgcgtggtgggtgattccaaccgtttgggtgccggttgcaagttggttcatttccaactccgtaaaatcaggcctcccttctcttgatgtagctctgctcgtctttcttggcatcttcgtttggactttggccgaatacacattgcaccgtttcctcttccatgtcaaaaccaagagctactggggaaataccttgcattatcttctccatggctgccaccacaagcaccccatggatagctatagacttgttttcccccctgtagctgcagctatattagccctcccgatctggaacttagtgaagcttatatgcaccccttcggttgctcctgccgtgtttggaggtattttgttgggctatgtgatgtatgattgcacccattactacttacaccatggtcaaccaaagtctgatgtgcccaaaagtcttaaggtaaaagtgtttcccctcctttag

SEQ ID NO: 3642 - DNA, 357 bp, Glycine Max; identical to SEQ ID NO: 505

SEQ ID NO: 3643 - DNA, 1005 bp, Glycine Max
atggttgttctttctcaccaatcagcactaaacgagttatttctcgtgaaaacatgcaagagcacgttcataggggtgcctgaggttgatctcacgcaccccgaggccaagacgaccatagtgaaggcatgtcaagagttcggtttgttcaaggtggtcaaccatggcgtgccgttggagttgatgacccatttggagaatgaagcgctcaagttcttcatgcagccacaatctctgaaagacaaggctggtcctcctgacccttatgggtatggaagcaaaagaattggcaccaacggtgatctgggttgggttgagtatctactcctcaacaccaaccctgatgttatctcccccaaaacacttcaactttttgaacaaaacccagaaatgttcaggtgtggagtggaggaatacataggggcagtgaagaagatttgctgtgaagcgttggagctaatggcagatgggttggaaatagtaccaaggaacgtgttcagcagaatgataagggacgagagaagcgatagttgcttcagaatgaaccggtacccagaatgtccagagcttaaggtagaagctttgagtggtcgaaatttgactgggtttggagaacacacagacccacagataatatctgtactgagatccaacaacacatcaggactgcaaatatgtctcccagatggagatggagatgggactacttgggcttcaatccagcctgatcacacttcctttttcatcaacgttggtgatctcttgcaggtgatgacgaatggaagctttaaaagtgttaagcatagggtattagttgattcaagcatgtcaagactttcaatgatttactttggaggaccacctttaaatgaaaagattgcacctttaccttcactcgtgtcaagggaagaagagagtttgtacagagagttgacatggctggaatacaagaatgctgcatacaagtcaaaactctctgataataggcttagtctctttgataaa

SEQ ID NO: 3644 - DNA, 771 bp, Glycine Max
atggtttatgacttctatgcatcaggggcagaggatcagtggactttgaaagagaaccgaaatgcattctcaaggattctgttccggctgcgtattcttgttgatttaagcaagatagacttgactacaactgtattgggcttcaaaatatcaatgcctatcatgattgctccaacagccaagcaaaagatggctcaccctgaagcatcatcgtattcctcacctcggcagcccaagtcaaatgttttctctttcaacttagtgttgaaagacaaaaatgtggttgctcagcttgtgagaagagctgaaagagcaggtttccaggcaattgcccttactgtggacagtccagttcttggtcgtagggaggctgacatcaaaaacagatttacattgccgccaaacatggtatttaagaattttgaaagattggatcttggaaagctggacaagacttgtgactctgttgttaccacttatgttgctgtactatttgatcggtcactcaactggaaggattgttttctcaatcatgaagccaattccatatactatgctaataatgtagcaaggatagccatacaagctggagctgctgggatcattgtttccaatcaaggagctcggcaacttgactatgtccctgctactattatggctttggaagagattggtagacctgtgatgttttcattggctgctgatggcaaggctggtgtaagaaaagtacttcgaatgcttgttgatgagttagaagtaactataaattga

SEQ ID NO: 3645 - DNA, 717 bp, Glycine Max; identical to SEQ ID NO: 506

SEQ ID NO: 3646 - DNA, 4080 bp, Glycine Max
atggttttcgctgtattcactgttctatcctgtgctgttatttctgttatgaacattgctcttgccttttaccaatacagctctaggagaataatcggatttaactctgtttccttggttctaacttgggttttggccactatagtttcgttttattcaatgaggactaaagtgagggagaacaagaggttcagatgcactattgctgtcttcaaagctgattcggtttctttgcctttgttggtacttctttgtttcaatgtgtgtgcaagggaaaacagtgatttggaacaagaacagatgttacttcaaaaagaggaggaatcttctatggaggaagaagacgaacaggcctttacaaatgcaagcatgtggagcaaacttgcatttcgatggttgaatcccatttttaaaacgggtcggattcaaaaacttgaacttggtcacattcctcctgttcctccttctgaaacggcagaaaatgcttcttcagtgttggaagaatcacttcgcaaacagaaacttaaaggaggttccttgacaaaagctattgcctattctatatggaagtccttggccttaaacgcagttttagctggtgttaacacaggtgcctcttatataggtcccttgttgataacaaattttgtgaattttttactgggggataatggtgattcaagcatccaatatggattggttcttgcatttatttttttccttgcaaagactgcggagtcactgagtcaaagacaatggtactttggtgctcaacgaattggaatccgggtgcgtgcggctcttacatctctaatttatagcaagtccctattgatgaagtgtgctggaccaacacaaggtaaaatcatcaatttgattaatgtggatgttgaaagaattggggacttctgctggtacattcacggagtttggttgcttccagttcaggtcattttggccttggtaatcttatacataaatctgggtggtactccttcttttgctgcatttggtgtcaccatattggtcatggtgtgtaacacacctttggccaataagcaagaaggtttgcactccaagattatggaagctaaggattcaagaattaaagtgacatcagagaccatgaagaacattagaattctaaaattgcattcatgggaaacttcattcttgcagaaactcctccaacttagggaaactgagaggaggtggctgcagaaatacctctatacatgctcagcagtagccacactattctggacatctccaactttagtttctgttgtcacctttggtgcttgtatactggtgaaaacagaactgacgacagctacagtactctcagctttagcgacttttcgtattctgcaggaaccaatctacaacttaccggagcttatctccatgatcattcaaacaaaagtctccgttgatcgaatccaggagttcattaaggaagacgatcaaaaccaattcataaacaggcatagttcaaagatttcagcagttgctattgaaattaagccgggcgaatatgtatgggaaacaaatgatcaaacccacaagaatccaacaattcaaattacaggaaagttagtgataaagaaaggtcagaaggtagcaatttgtgggtcagtggggtccggtaaatcaagtttgatatgctgtttgcttggggagattccattagtttctggggcagtaaccaaagtctatgggactagaagttatgtgccccaaagtccatggattcagtctggaactgtaagagagaatatattgtttggcaagcaaatgaagaaggacttttatgaagatgttttggatggctgtgctttgcaccaagacatcaacatgtggggtgatggagatttgaacccggtggaggagaggggcataaacttgagtggtgggcagaaacagcggattcaattggcaagggctgtttacaatgattctgatatttatttccttgatgatccttttagtgctgttgatgctcataccggaactcatttgtttaagaaatgtctcatgaaacttttatatgataaaacggttgtttatgctacccatcaactggaattcttggaagctgcagacctcattttggtaatgaaagatggaaaaatagtggagtcaggaagctataaagatcttatagcatgtcccaactctgaacttgttcaacaaatggctgcttatcaagaaacattacaccaaataaatccatgccaagaagatgattctgctagctgcagaccctgccaaaaaaatcaaattgaagattggggaagaagtaaagaagaggaagcagagacgggtagagtgaaatggagtgtttactcaacttttgtcatatctgcttataaaggagtgcttgttcccgttattcttctctgccaaattctctttcaagttatgcagatgggaagcaattattggatttcatgggctacagagcagaaaggcagggtcaacaacaaacagcttatgggaacatttgctcttctatcttttggtggcaccatcttcatactgggaaggactgttttaatggcagctgttgctgtggaaactgctcaacgcctttttcttggaatgatcacatcagttttcagggcacctgtttcattttttgacaccacaccttcaagccgaattatgagtaggtcatcaacggatcaaagtactgtagacacagacataccatacagattagctggactagtgtttgcacttatccagttattgagtatcattgtgctaatgtctcaagttgcatggcaagtcattctcctcttttttgtggtgtttgcaatttccatttggtatcaggcttattacatcacaacagccagggaattagccaggatggttgggattcgaaaggcaccaatcttgcatcacttctcagaatcaattgccggggctgctacaatccgctgtttcaatcaagagaaactattcatgaccaagattaaggctctaattgacgattattctcgggtagcctttcacaattttggcaccatggaatggctgtctgtccgaatcaatttcctcttcaatttggtcttctattttgtacttgtcatcttggttactcttccaaggtctaccattgatccaagcttggcgggtttggtagctacttatggtttgaacttgaatgtccttcaggcttgggtgatatggaatctttgcaatgttgagaacaaaatgatatcagttgagagaatattgcagttctctagcataccaagtgaagcgccattaattattcaagattgcagacctgaaccagagtggccaaaggagggaaaagttgaactacgtaaccttcatatacggtatgaccctgctgctcctatggtcctcaaaggtgtcacttgtgtcttccccgcacaaaagaaaattggtgtagtaggcaggacagggagtggaaaatctactctggtgcaagccctctttcgagtggtggagcctttggaaggatgtatacttattgatggtgtagatatttccaagattggtctgcaagatttaagatctaagcttggtataattcctcaggatccaaccttgtttctaggtactgtaaggactaacttggatccactagaacaacatgctgatcaagaactttgggaggttctcagcaagtgccatcttgctgaaatagtgaggcgggatccaagacttcttgatgcaccagtggccgagaatggagagaattggagtgttggacaaaggcagcttgtatgccttgctaggttactactgaagaaaagaagaattttggtcctagatgaggcaactgcatcaattgacactgccactgacaatttaattcagaagacaattagggaagaaacaaatggatgtacagttattacagtagcgcatagaattcctacagttattgataatgatcgggttttggtccttgatgaagggacaattgtagagtatgatgaaccagctcaattgctgcagaacaattcttcttcattctcaaagttagtctcagaatttttgaggagatcatcccaaagtagcttccagaaaagatag

SEQ ID NO: 3647 - DNA, 11154 bp, Glycine Max
atggtttttcaaagatcaataaacattttagtttctgattttgatttattcattgtggtcatattgacccaaattcatactgtcaatgcaatactacaatgccagtggattaaatgtttcattgatcatgttacttcagttccacttgagaagatagaagaacctttaaagggttttgtttgggagtttgataagggggattttcatcactgggttgatctttttaaccatttcgattcattctttgagaagtatgtaaaaccaaggaaggatctgcagattgatgatgattttctggacttggatcctccattccccagagaatctgttcttcaaattcttcgtgtcatcagaataattttggataactgcacaaataagcatttctatagttcatatgagcagcatctttcagcattgcttgcttctactgatccagatgtggttgaggctagccttgaaactttggctacctttttgaagaaaacagttggaaagtactccataagagaaacttctttgaattcaaaattgtatgctcttgcccaaggatggggtggaaaggaagagggtcttggactgattgcatcagctgtgcctaatggttgtgaccctattgcctgtgaattgggttgtacccttcattttgaattttatgcagtaaatgagtcagaaagtgacgtcaaggtgactgaacccttggtccaaggcttgcaaattattcacttatgtgatgtcaacaaatgtgtggaaactgatcttgagcttttgcataagttagttacagaatataaggtacctgccagtttaagattttctttattgacaagactgcggtttgctagggcttttggttctttggcttctagacagcaatatacatgcattcgcttgtatgccttcatagttctaattcaagcatgtgctgatgctgatgacctggtttggttcttcaatgcggagcctggattcatcaatgaattagtatcattgctgagctatgaagatgcagttttggaaaaaattcggattttatgtttgcactcgttagctgctctttgccaagatcgttcccgtcaacagtcagtacagactgcagttacatctggtgggcaccgtggcattttatctagtctgatgcaaaaagccattgactccgttactagtgatacctcaaaatggtcagttcattttgcagaggcactattgtctcttgtcactgtgttggtttcgacatcgtctgggtgctctgccatgcgtgaagcaggatttattcctaccctgctacctctccttaaagatacaaatccacagcacttgcatttggttgaaaaggctgtgcgcattttagaagcttttatggattacagtaatccagctgctgctctgttcagagatttgggaggtttggatgataccatatctcgcctaaagattgaagtttccaatgtagaaaatggtggaaagccgccagatgataattctgagtctagtgcaagaagtgtaaatatggttggaagttcttcaactgggctagacgatacacaacctttgtattctgaaccattaatttcatatcaccgtcggttgctgatgaaagctttattgcgtgctatatccttgggaacttatgcccctggaaatactgctcgtatctatggatctgaagagaatgtgctgcctcattgcttatgcataatttttagaagagcaaaagattttggtggtggagttttttctcttgcagctactgtcatgagtgacttaatacaaaaggatcctacatgttttcctgttttagattcagctggtcttccgtctgccttcttggatgctataatggatgatgttctcaactctgcagatgccattacctgcatcccccagtgtttggatgccttatgcttaaatagtaatggcctgcaggctgtgaaagatagaaactctctgaggtgttttgtgaaagtgtttacttctagaacatatttgcgtgctcttgcaggggacacacctgcatctttgtctagtggactggatgaattaatgcgccatgcttcctcattgcgtggccctggagtggaaatgttagttgagattctggaaactatctcaaaaattggttctgcagtggattcgtcatccttgagtcctgatccatgctcttcaacctctgttcctatggaaatggatggtgaggacaagagtttgatcttgcctaataacaaggagtcatccaaggctgatgacacagagcagacaactgagccatctcctgatgtgccaattgtaaatgtcgagccatttcttccagattgtgttaacaatattgctcgtctacttgagacaattcttcagaatgccgatacatgtcgtatatttgttgagaaaaagggaattgaagctattctgcagttagttgccttacctttaatgccaccttctatttctgttggacagagtatatctgttgccttcaagaatttctccccacagcattatgtttctcttgcccgggctgtttgctccttcttgagggaacatctgaaatctaccaatgagattttagatttggtggggggaactcaacttgctctagtggaatctgcaaagcagactaaggtgttgaaatatcttgctagcctggaagctgtcttaactctttctgtgtttttgttgaagggttcaactactgttgtctctgaactaagcacttcggatgctgatgtgttgaaagatcttgggaaaacatacaaggaactaatttggcaaatatcattgtgtaatgattctaaggccgaggaaaagaagaatgctgatcaagaacctgaggttgcacaggtacccccatctactgctgttgaaagagagagcgatgatgattcaaatattcagacagtaagatcactgtggcgtggagcacgagaattagtttctgttgttcgtggagaaagtttgcaccgccgaagtcggcatgggttatcccgcatacgaggtggaaggactggtcgtcacttggaagctttaaacattgattcagaagcagcttctagtgctctggaagcacctttatcccaagatctgaaaaagaaaagccctgatgttcttggtttagagatccttaacaaactggcatcaacattgcgctctttcttcactgcccttgtgaagggattcacttcaccaaatcgtcgcagagctgactcaggatcacttagttcagcttcaaagactcttggagctgttttggctacgaattttttcgaggctcttagtttttctgggcattctacttatgctggacttgaaatgtcactttctgtgaaatgtagatatcttgggaaggttgtggatgatatggctgctctcacatttgacagcaggcgccggagttgttatactgccatggttaataatttttatgtccatggaacatttaaagagctactcacaacatttgaagctaccagtcagttgctatggacacttccatactctcttccattatcagatattgatgttggaaaaaaaggggaaggaggtaaactgtcccataacacatggctacttgatacactgcaaagctactgtcgtttgcttgagtattttgtaaactcgtcttttcttttgtctgccacctcggcatctcagacagagcttcttgttcagccagttgcagttggtctctcaattggactctttccagttcctagagacccagaagtttttgtccgtatgttacaatctcaggttctggatgtaatcctaccagtctggaatcatcccatgttttgtagttgtagtcctggtttcattgcatctattatttcccttgttacacatgtatattctggtgttggagatgtcaagcgtaatcatagtaacattgtaggaagcacaaaccagcgtttcatgccccctccacctgatgaggcaaccattgccactattgttgagatgggcttttcaagggcaagggctgaggaagcattgagaagagttgaaacaaatagtgttgaaatggccatggagtggctgtttagtcatgctgatgatcctgtccaggaggatgatgaacttgcacgggcacttgctctgtccctaggaagcagttctgaatctactaaagctgagagtgctgagaagactatagatgtgctaactgaagagggacatgtgaagaaacctccggttgatgatatacttgctgcatctcagctaaaactttgtccattggacttgtcccaggataactgtgcattgagtgtgttagcacatatcttagcactgcttctttttgaggatgtaagtacacgggaaattgctgctcagaatggcattatatctaccattatagatatcttgacaaacttcaaaggtagacaggagttggggaaagaaataccagtacctaaatgcattagtgctttactacttatattggatcaaatggtgcagtcaagaccgaaagttgaaaatattgaaggaacccagactgcttccctgccagattcttctggggagcaatttcctgatacagttttaccaaaggaaaataaatcaaatgggaatgagaaagaacctgctatggcttttgagaatatactgggaaaatctactggttttgcaactattgacgagagtcgtaaattgctggatattgcatgtgatctgataaaacagcatgttcctgctgttgtcatgcaggctgttctgcaattatgtgctcgattaacaaaaacacatgctttagctttacagttccttgaaaaaggaagtctggttgctctttttaatcttccaaggacttgctttttccctgggtatgactcagttgtgtcagctatagtccggcatctccttgaagatcctcaaacactacaaacagccatggagttggagatacgacaaactttaagtggaaatcgccaatcagggcgtgtctctcctcgatcatttttgacatcattggcacctgttatctctcgggatcctatggttttcatgaaagctgcagcagcagtttgtcagatagaaacatcagggggaaggactgttgttgtgttgtccaaggagaaagaaaaatcaaaatcatcaagtgttgaggttgggttatcttcaaatgaatgtgtccggatacctgaaagcaagccacatgatggaccggggaaatgtttgaaaagccacaaaaaggttcccgttaatctcactcaagtaattgatcagcttcttgagattgtgcttaagtacccacttgtgaaaggtcaggaagattctgagtgtgactcaacttccatggacatagatgagcctaccatgaaggtgaagggtaaatctaaggttgaagaggctgggatattagagcctgaatctgaaaggtctacaggactggtgaaggtgacttttgtcctcaagttattgagtgacattcttctaatgtatgggcatgcagtaggtgtcatactcagacgtgattctgaaatgtgtcaattccgtggatctaatcagccttctggacatagtggtattattcatcacgtattacatcggttgttacctctctctgttgataaatctgccggacctgatgattggagaggtaagttgtctgaaaaggcttcatggtttttggtagttttgtgtggtcgatctggtgaagggcgcaaacgagtgacaaatgaacttgttaaagaattgatgtctttttcaaatctggagagcaattcaatgaaaaacagcttattgccagataaaaggctattcacttttgttgatctagtgtattctattttgtcaaaaaattcgtcatctggtagcctacctggtactggatattcacctgatattgcaaaaagcatgatagatggtggaatcattcagtggctaactagtattctgcaagtggttgatttggatcatcctgatgcacccaaaattgtgaatcttatactcaaaggtttagaaggtcttacaagagctgccaatgcaagtgagcaaatctttaaatctgatggaactgaaaagaaaagatctgctggtttaaatgatagatctgatgatcaaataacagcaccatctgcagctgaagcagtggcacatgatcagaatgtgggcagtcaagaagcaatcagagatacaatggataatgcacttgatcaaggaacttctcaaggtgatgatcgtgctgataatccaaatcaatcaatggaacaagatatgagagtagaagaacggggagtaatggctcaaaacccatcaatggaacttggaatggacttcatgcgagaagagatgggagaaggtggtgtcttgcacaacccagatcaaattgagatgacttttcatgttgagaatagggctcatgatgacatgggtgatgaagatgatgatatgggtgacgaaggtgatgaggatgaggatgatgatgagggagaggatgaggacgaggatatagcagaagatggtgggggcatgatgtccttggcagacactgatgtggaggatcatgatgatgttggctttggagatgaatacaatgatgagatgattgatgaagatgatgatgattttcatgagaatcgtgttatagaggtgaggtggagggaagctcttgatggcttggatcacttgcagatacttggccaacctggatttatagatgtggctgctgagccttttgaaggtgttaatgtggatgacctttttcgtcttcagagttttgaacgccgccgtcagactggtaggtcttcctttgagagatctgccacagaagtaaatggttttcaacatcctctccttgttagacctccaccatctggcgattttgtctcaatgtggtcgtcaagtggtaattctgcatcccgagattcagaaaccctgccatctgggaatcttgatgtggcccatttctacatgtttgatgcacctattcttccatatgatcatgtgccaagtagtctgtttggagaccgtttgggtggtgcagcacctccacctctaacagattattctgtgggtatgggctcattgcatctacctggaagaagagtgttaggtaatggtaggtggactgatgatggtcagccacaaggaagtgctcaagccgctgccattgcgcaagcagtagaggaacaattcctagctcaactgtgcagtgtagctcctgaaagcagtcctgttgaacgacagttacagaattctggagaacaagagaacaagtctgatgctcttgcatcacatgatgatccaatattgactgctggaactgactctacttctcagcagattgatagtcaggagcaagaaaatggtaatggaatcagagctcagcaaatcaatgatggtgctctttgtgaggaagagataaatgtagactctggtgctcaagatacagctgaagacctgcaagctaatgagcctatgttggttcaaccagtttcattgactatcatgccaaatggtcttgattgcacagtgattgaagaaaatgccactcatgatgagaatgtagaaatagctcaggcatttgtcaattcatctattaattctgatgctgctatacaatttgagtccatggaatgcaatggatcatcaaatgctgacgggcagcctcctaatgttgagttaggggactctggttttgaaactcttaatccaggtgattcccatgcatcatcaatttatgctagtgctgatgttgatatgggtggtactgatgctgaaggaaatcaatcagagcaaccaactgtatctgaagacaggagggatgagatgttatcaactcagaacactgaggttgctccagatgcaactcaggccgaccaagttagtgcaaataatgaagcttccggtgctaatactatcgaccctacctttttggaggctctgcctgaagatcttcgggcagaagttctggcatcccaacaagctcagtctgttcaacctccagcttatgcaccaccttctgcagaagatattgatcccgagtttttagctgctcttcctccagatattcaagcagaagttttggcccaacaaagagctcaaagggttgcccagcaggctgaaggacagccagttgacatggataatgcctctataattgctacttttcctgctgatttgcgtgaagaggttcttttgacttcttcggaagctgttctgtcagcactaccatccccgttgcttgcagaagctcaaatattgagggatcgagcaatgagtcattatcaagctcgcagccttttcgggagcagccacaggcttaacaatcgaagaaatggtcttggatttgaccagcgacctgtgatggatcggggtgttggagttacaatagggaggagatctgttcttacagatagcttgaaggtgaaggagattgaaggtgagccactacttgatggaaatgcattaaaagctttgatccggcttctacgactgtcacagccccttggaaaaggccttttgcagagactcttgttaaacttatgtgcacatagtgttacaagggccactcttatttatcttttgcttgacatgattaaatctgaagctgaaggctctgtaggtagaccagcgacattaaattcccagaggctttttggttgtcactcgaacacagtttatggtcgatctcaattgttggatggtcttcctcctcttgtgttccgccgaattcttgagattctaacttatttggccacaaatcattctgctgttgcaaaaatgttgtttcactttgatcaatcagttattccagattcttcatctccagttaaggtgcatatgaatgagaaagggaaagagaaggttattgaagggggaccatcacctaattcctctggagctcagacaggggatgttcccctagtgctctttttgaagctcttgaaccgacccctgtttctacgcagcaatgctcatcttgagcaggtcatgggtctgattcaagttgtagttgatactgcagcttcaaaattagaaagtcaatcacagtctgaaaaaggaatggcagatacccaaaatttgtcaaccagtgaagctccaagtaatactgaaaaggatgctgctttggtggagtcggactctaatcaacaagataagcatgcagatgtaaatccatgcccttctgaagggaagaagaatgtagatatgtacaatatcttcttgcagttgccgcaatctgatttgcgaaatttgtgcagtcttcttggtcgggaagggctttcggataaaatgtatatgcttgctggtgaggtggtgaagaagttggctttcattgttccctcccataggaagttctttactttagagctttcagaatcagctcatgcattgacaggttcagccatcagtgagcttgtcacactacagaaaacaaatatgcttggtttgagtgctggttctatggctggtgcagccattctacgagtgctgcaagctcttagttcactcacttcacttaatactttgggtgatatggatatggaaaatgatgtggatcagcatgatgatcaagcaactatttggaatttgaatactgcactcgaaccattgtggcaagaactgagtaattgtataagtgcagctgagatgcagcttggacagagctctttctcttctaacatgtcaaacataaatgttgcggagaatctgcaaggttcctctacttcaccacctcttcctcctgggacacagagactcttgcctttcattgaggctttttttgttttgtgtgaaaagctacaagcaaatgaatccttcatgcagcaagaccattgcaatgcaactgccagagaagtcaaggagtctgctggttgttcagcttcaacaagtgttaaaattggtggagacccacagcgaaaatatgacggtgctatcactttcacgaggtttactgagaagcatcgccgactgtcaaatgctttcattaggcagaatccaggattgttggagaaatcactttccatgatgctcaaggcaccaaggctgattgactttgataacaagagagcctatttccgctcaagaataaggcaacaacatgaccaacacttgtctgggccattgcgtataagtgtaagacgggcttacattttggaggactcttataatcagctaaggatgcgtcctactcaagatctaaaggggcgattaaatgtgcaatttcaaggtgaagagggtattgatgccggtggtctcaccagagaatggtatcagctgctgtcaagggtcatattcgataaaggtgctttacttttcacaacagtgggcaacaatgcaactttccaaccaaaccctaattcagtataccagactgaacatctctcatacttcaagtttgttggccgagtggtggggaaggctttgtttgatgggcaactgctggatgtttactttactcgatctttctataagcatatacttggtgttaaggttacataccatgatattgaagcggttgatcctgattactataagaatttgaaatggatgctggagaatgatgtgagtgatattcctgacctgacatttagcatggatgctgatgaggaaaagcacatactttacgagaagaatgaggtcactgattatgagcttaaacctggaggaaggaacataagggtcacagaagaaacaaagcatgagtatgttgatcttgttgctgaacatcttttgacaaatgccatccgtcctcaaattaattcctttctagaaggttttaatgaattggtaccacgagaacttatatccatatttaatgacaaagagcttgagcttctcataagtggtcttccagaaattgatttggatgacttaaaggccaacaccgagtatactggttatacagtggcatcaaatgttgttcaatggttctgggaggtggtcaaagctttcaacaaggaagacatggcaagattactgcaatttgtgactggaacgtcaaaggttcctttggagggttttaaggccttgcaaggcatctctggtccacaaaggtttcaggttcacaaggcatatggagctcctgatcgacttccatcagctcatacttgcttcaatcaacttgaccttcctgagtatacctctaaggaacagcttcaagaacgtttgttacttgccatccatgaggctagtgaagggtttggttttggttga

SEQ ID NO: 3648 - DNA, 11154 bp, Glycine Max; identical to SEQ ID NO: 3647

SEQ ID NO: 3649 - DNA, 234 bp, Glycine Max; identical to SEQ ID NO: 507

SEQ ID NO: 3650 - DNA, 1482 bp, Glycine Max
atggtttttccaaaacccgcttctgagtctgatctctttcttcattccaactttgcttctcgttatgccagggactctcttcccaggttcagcatacccgaggactccatgccaaaggaggctgcgtatcagaacatacacgatgagttgcagcttgatgcaattccaaagctgaacttggcttcctttgtgacaacttccatggaagaagagtgcaacaagctcatcatggaatcgataaacaagaactatgtcgacatggacgaatatcctatcaccactgaccttcacaatcggtgcgtgaacatgatagcacgtttattccatgctgaaattggagaaaatgagattgcaactggagcaggaaccgttggatcatctgaggccataatgctggcagggcttgcattcaagaagaagtggcagaacaagcgcaaggaagagggaaagccttatgataagccaaatttggtgactggttccaacgtgcaggtatgttgggagaaatttgcgaggtattttgaagtggagttgagagaagtggaggtgagggaaggctactatgtgatggaccctgccaaagcagttgaaatggttgatgagaacactatttgtgtggctgcaatcttgggttcaacttacaatggagagttcgaagatgtcaagctcctaaatgacctattgctagaaaaaaacaagcaaactggatgggatacacctattcatgtggatgctgcaagtggtggctttattgctccattcctttatccagagttagaatgggattttagactcccattggtgaagagcataaatgttagtggccacaagtatgggcttgtttatgctggcattggttgggttatttggaggaccaaggatgacttaccagaagaccttgtcttccatattaattaccttggagctgaccaacccaccttcaccctcaatttctctaaaggttctagccagatcattgctcaatattatcagctaattcgtcttggccaagaggggtaccgaagcataatggagaactgcagagaaaatgcaatggtgctgaaggaagatttggagaaaagtggtcactttaacattctctcaaaagacgatggtgttcctgtggtggcattttctctcaaagacagaagccggtacgatgagttcaagatatcagagatgttgcgccgccacggttggatcgtgccggcgtatccaatgccacctgctgctcaacacatcaatgtgctccgtgtggtcatcagggctgagttttcacgcacccttgctgaacgccttgcgtttgacatacacaatgtgatggatgaacttgaaaagttgcatccccccatagtgaccaaaaacacaaaggaagagaacaaggccatggttgaaaatggggtgaagaacactgcattggatgcacacagggaaatcattgctcaagaatccaacaagcgtcagaaaatcatggcagcttag

SEQ ID NO: 3651 - DNA, 1482 bp, Glycine Max
atggtttttccaaaaccctcttctgagtctgacctctttctttgttccaactttgcttctcgctatgccagggactctcttcccaggttcagcatgccagagaactccatgcctaaggaggctgcgtaccaaaacattcacgatgagttgcagcttgatgcaattccaaagctgaacttggcttcttttgtgaccacttccatggaagaagagtgcaacaaactcatcatggaatccatcaacaagaactatgttgacatggacgagtatcctgccaccactgaccttcacaatcgatgtgtgaacatgatagcacgtatgttccatgctgagatcggagaaaatgagaatgcaactggagcaggaacagttggatcatcagaggccataatgctggcagggcttgcattcaagaagaagtggcagaacaagcgcaaggcagagggaaagccttatgataagccaaatttggtgactggttccaatgtgcaagtatgttgggagaaatttgcaaggtattttgaggtggagttgagggaagtggaggtcagagaaggctattatgtcatggaccctgccaaagccgttgaacttgttgatgagaacactatttgtgtggctgcaatcttgggttcaacttacaatggagagttcgaagatgtcaagcttttaaatgacctgttgctagaaaaaaacaagcaaactggatgggatacgcctattcacgtggatgctgcaagtggtgggtttattgctccattcctatatccagagctagaatgggatttcagactcccattggtgaagagcataaatgttagtggccacaagtatgggcttgtttatgctggcattggttgggttatttggaggaccaaggatgacttgccagaagaccttgtcttccatattaactaccttggagctgaccaacccaccttcaccctcaatttctctaaaggttctagtcagatcattgctcaatattatcagctaattcgccttggccatgagggataccgtagcataatggagaactgcagagacaatgcaatggtgctgaaggaaagtttggagaagagtggacactttaacatactctcaaaagacaatggtgttcctgttgtggcattttctctaaaggacagaagccagtacgatgagtacaagatatcagagatgttgcgtcgccacggttggattgtgccggcatatccaatgccaccagctgctcaacacatcaatgtgctccgtgtggtcatcagggctgagttttcacgcacccttgctgaacgccttgtgtttgacatatacaatgtgctgcatgaacttgaaaagctacatccccccaaagtgaccaacttcattaaggaagaaaacaaggccttggttgaaactggtgtcaagaaaactgcattggatgcacatagggaaatcattgctcaagaatcaaacaagcgtcagaaaattatggctgcctaa

SEQ ID NO: 3652 - DNA, 1434 bp, Glycine Max
atggtttttccaagacctccttctgagtctgacctctttcttcattccaactttgcttctcgctatgccagagactctcttcccaggttcagcatgcccgaggactccatgccaaaggaagctgcgtaccagaacatacatgatgagttgcagcttgatgcaattccaaagctgaacttggcttcctttgtgaccacttccatggaagaagagtgcaacaaactaatcatggaatccatcaacaagaactatgttgacatggacgagtatcctatcaccactgaccttcacaaccggtgtctgaacatgatagcacgtatgttccatgctgagatcggagaaaatgagaatgcaattggagcaggaacagttggatcatcagaggccataatgctggcagggcttgcattcaagaagaagtggcagaacaagcgcaaggcagagggaaagccttatgataagccaaatttggtgactggttccaatgtgcaagtatgttgggagaaatttgcaaggtattttgaggtggagttgagggaagtggaggtcagagaaggctattatgtcatggaccctgccaaagccgttgaacttgttgatgagaacactatttgtgtggctgcaatcttgggttcaacttacaatggagagttcgaagatgtcaagcttttaaatgacctgttgctagaaaaaaacaagcaaactggatgggatacgcctattcacgtggatgctgcaagtggtggaatgggatttcagactcccatggtgaagagcataaatgttagtggccacaagtatgggcttgtttatgctggcattggttgggttatttggaggaccaaggatgacttgccagaagaccttgtcttccatattaactaccttggagctgaccaacccaccttcaccctcaatttctctaaaggttctagtcagatcattgctcaatattatcagctaattcgccttggccaagaggggtaccgcaacataatggagaactgcagagaaaatgcgatggtgctgaaagaagatttagagaagagtggacactttaacatactctcaaaagacgatggtgttcctgtggtggcattttctctcaaagacagaagccggtacgatgagttcaagatatcagagatgttgcgccgccacggttggatcgtgccggcatatccaatgccaccagctgctcaacacatcaatgtgctccgtgtggtcatcagggctgagttttcgcgcacccttgctgaacgccttgtgcttgacatacacagtgtgctagatgaacttgaaaaggtacatccctccaaagtgaccaaaaacacaaaggaagagaacaagttattggttgaaaatgggtctttatacacaatgataatagaacttcagaaaaagaaagttaatacttataactcggggatataa

SEQ ID NO: 3653 - DNA, 1563 bp, Glycine Max; identical to SEQ ID NO: 508

SEQ ID NO: 3654 - DNA, 225 bp, Glycine Max
atgtacattataacattaagcacatggttccagttatgggttgttggaaaagaaagaaaaaggttcccgaccaaaatccagtggggtggccatgccagtccaagttgcccaactatttcatgcatttttttaagaggaagaagaaatccaagagaagaagaaaataaaagaaatgagaatagtgtatatatatgttccttggtttattttccagctgttacttga

SEQ ID NO: 3655 - DNA, 594 bp, Glycine Max
atgtatattatttactctctcctcaagacagacaccaatgctaaaaaagggaagggagaaaaagccatgagaaattgcataaggtgctgcatctcttgcatcttcccatgtggggctctcgacgtgatccgcatagtgcactccaatggcagagtagaagaaatcagcggcaccgtcaaggccagtgatgtcatgaaggcacaccccaaacatgtcctcaagaagccatgctcttcccccgccgatgccgccggcatcagcggcggggtccacaagatcgtggtggtgccacccgacgctgagctccaacgtggcaagatttacttcctcatgccactccctcctactcctcctacacaagagaagaagaaccggcagagaaagaagaagaggaaggaacatagagagagaactatgaacaacaccaacaacgcgtccatgattacgtctatgactagcttgcttgtctctgatcgctacttgaatgatatactctcagagaaggtgtcaagtcaaagagacagaagaagagggcgtgttgctgtgtggaggcctcacttggagagcatttatgagtcaccttctgatccgtaa

SEQ ID NO: 3656 - DNA, 1488 bp, Glycine Max
atgtatcaaatagtaaaatacatacaagtgggtaaaggaagggatgtgggtcttaaccagatatcaatgtttgaagcaaaaatcgctgctgggaatggtgagcaaacaatgagtagagacatatacaggcttggacaccgttttgatttcttccgaatgctatcttgttattacactaccattggcttctatttcagtaccttgataactgtcctcacagtttatgtattcctttatggacgcctctatcttgcccttagtggactcgaagaaggtttgaaccaaaaaagagctattcgagacaacaaagctcttcaagtagctcttgcttctcagtcagttgtgcaaattggatttttgttagccttgcctatgttgatggaaattggcttggagaggggatttcgtgaggctttaagtgaatttgtactaatgcaactacagttggctcctgtatttttcacattttctcttggaacaaaaacacactattatggaaggacattgcttcatggaggtgcagagtacaaaagcactggtcgcggttttgttgtgtttcatgccaaatttgctgataactataggctttattcccgcagccattttgttaaagggattgaattgatgattctgcttgtggtctaccatatatttggccatgaatacagaggagtgcttgcctatattttaattaccgtaacaatgtggttcatggtagggacatggctttttgctcccttccttttcaatccatcaggttttgagtggcagaagatagttgatgactacacagattggcaaaaatggataagcaaccgtggaggcattggtgtatctcctgaaaaaagttgggaatcctggtgggaaaaggaacatgagcatctccggcactccggaaagcgtggtatcgctactgagataatattatccctccgctttttcatttatcaatatggccttgtttatcacctttcaatcactgataagactcaaagtgttttggtttatggtctttcttggatgataatctttgtaatattgggtttaatgaagggtgtatctgttggcaggcgccgcctcagtgcagactaccaacttctatttcgattgatcgtgggttctattttcttaacattccttgccatcttcataatcctaatagcagttgccaagatgacaattaaggacataatagtctgcattcttgcagtcatgccaacgggctggggaattctgctgattgcacaagcttgcaagcctctcattaaaaaaacttggttttgggggtctgttcgagcacttgcacgcggatatgaagtaataatgggcttgcttctcttcacaccagttgctttcttggcatggttcccatttgtttcagagtttcaaactagaatgcttttcaaccaagcttttagcagaggtttgcagatttctcgtattcttggtggacaaagtaatgaacgctcctctaaccacaaagagtga

SEQ ID NO: 3657 - DNA, 582 bp, Glycine Max
atgtatcagaaccccatctcggcatttcggattgcacaacaatacagtcacagaaacagagaaaaaacaaagaaaatggatgcagaaacggagtctccggcgccggaaacatcgccggcggtgatccacccggcagtggcaccaatctcctaccttctgggcacatggagaggccaaggagaaggaggcttccccactatcaattccttctcctatggcgaagagcttcacttctcacattcccccaacaagcccgtgatagggtacactcagaagacatggaaactcagctctggagagcctatgcatgctgagagtggatactggcgtcctaaacctgatggcactattgaagttgtgattgctcaaagcaatggtcttgtggaagttcagaaaggaacatacagcgctgaagagaaagtgatacagcttcagagtgaaatagtggggaacgcttctaaggttaaagagataagaagatgtttccagctggttgatgggaatctttgttatgacgttcagatggctaccaataaaataactcttcaaccacacttgaaagcgtcactgaagaagctctaa

SEQ ID NO: 3658 - DNA, 1668 bp, Glycine Max; identical to SEQ ID NO: 509

SEQ ID NO: 3659 - DNA, 1566 bp, Glycine Max; identical to SEQ ID NO: 510

SEQ ID NO: 3660 - DNA, 1146 bp, Glycine Max
atgtatcgcgttcttcaccgcgctttctgcaccgccaccgagcccgccaccaccgccaccgtcaccgtttccatcaagtccatttcggaggatctgtacaaggaagtgaagctaaagaatgtggtggagaagttcaagaaagcctcggacatcgaccgcttccgcaaaaaaaccggcatctacgaagacaccgtccgccgcctcgccggcgcccgacgcttccggtggatccgcgacatcctcgagcaccagaagcagtactccgacatctccaacgagggcttctccgcgcgcctcatctccctgtacggcaagtccggcatgaccaagcacgcgcgcaaggtgttcgacgaaatgccgcagcgaaactgcagccgcaccgtgctctccctcaacgcactcctcgctgcgtacctccactcccgcaaatacgacatcgtcggagagcttttcagggacctcccaacgcagctctcaatcaagcccgatttggtgacctacaacaccatcatcaaggcgttttgcgaaaagggttcgtttgattccgcattatcagtgtttcaagagattgaggagaagggtttgagccctgattccatcacgttcaacactttgcttgatgggttgtattcaaagggtcgttttgaggagggtgagaaagtgtgggagcaaatgggtgtgaagaatgttgctcctggtgtgaggagttactgctccaagttggtggggttggctgaggtgaagaaaatgggtgaagcagttgtgctttttagggaaatggagaagttgggtgtgaagcctgacctcttctgcatcaatgctgtgatcaaaggtttcgtgaatgagggtaatttggatgaggctaagaagtggtttggtgagattgcaaagtttgagtatgaccctgataggaatacttactctatcattgttccattcctctgtgagaagggtgatttcaagactgccattgatatgtgcaaggagattttcaacaaccggtgccgtgttgatgcaacgttgctgcagggcgtggtggataagctggcgagtgagggcatggatacagaggcgaaggagattgtggagatagggaaaaccaataggtattgtcgctataggctagatttgccagcagagaagtag

SEQ ID NO: 3661 - DNA, 987 bp, Glycine Max
atgtatgcagcaatcttcaatgtgggctgggccgctactcaggtttcacacatgtccatggtgagttgcatcacgctgaactctacaagcagagtggcactggctagctgtcgcaatgcttttaccatggttgccaacctgagcctgtatgcagttgcattgatagtattcagtgtcatcaatggaaaaacacatgatgatgttgaaaatcagtaccgctggattgcatatctgtcaatttttattggatgttgctttgtgggcgtatttcatcttgcaaccaaagagcccagattgaaggtgggtgtacatggaatggttcatgcaaggatttcatgggattactggttcaagagaattctatattatcaggttgctcttgtttatgttcttacaagattggttctcaacgtttcacaggcataccttgctttctttgtcatcaatgacctacaaatggcccaatcagccaaagctttggttcctgctctcatatacatctgcagctttgttgtgtctatagcattacaggagattgcatggactggccgaatgcttaaggcctactactctgctggatgcattctttggattttttgtggtgcagtgatccttcttttaaccacaaatatgagttatgtcatgtacatagtatcggtattcattggcatagcaaatgctctcatgatggtaactggagtaagcatgcagaattttctcattggagagaaccttaatggttgtgcatttgttgttggatcattgagttttttggacaaaatttcatgtgggcttgctttatatgttcttcagtcaaaccaaaatctctctccgcagctccaggcaacaacccaattccccttttcagttacaaggattggtttgggtcttgttcctgcattttgtgcactagttggggtggtagtgacttgcaccatggatttccacaatccttcaaagtctttgacggcaccactattagcctag

SEQ ID NO: 3662 - DNA, 1089 bp, Glycine Max
atgtatgcagcaatcttcaatgtgggctgggccgctactcaggtttcacacatgtccatggtgagttgcatcacgctgaactctacaagcagagtggcactggctagctgtcgcaatgcttttaccatggttgccaacctgagcctgtatgcagttgcattgatagtattcagtgtcatcaatggaaaaacacatgatgatgttgaaaatcagtaccgctggattgcatatctgtcaatttttattggatgttgctttgtgggcgtatttcatcttgcaaccaaagagcccagattgaaggtgggtgtacatggaatggttcatgcaaggatttcatgggattactggttcaagagaattctatattatcaggttgctcttgtttatgttcttacaagattggttctcaacgtttcacaggcataccttgctttctttgtcatcaatgacctacaaatggcccaatcagccaaagctttggttcctgctctcatatacatctgcagctttgttgtgtctatagcattacaggagattgcatggactggccgaatgcttaaggcctactactctgctggatgcattctttggattttttgtggtgcagtgatccttcttttaaccacaaatatgagttatgtcatgtacatagtatcggtattcattggcatagcaaatgctctcatgatggtaactggagtaagcatgcagaattttctcattggagagaaccttaatggttgtgcatttgttgttggatcattgagttttttggacaaaatttcatgtgggcttgctttatatgttcttcagtcaaaccaaactccaggcaacaacccaattccccttttcagttacaaggattggtttgggtcttgttcctgcattttgtgcactagttggggtggtagtgacttgcaccatggatttccacaatccttcaaagtctttgacggcaccactattagcctagctgtgtcattgatcataattattctcctttctctaacatacaaaggtaaatggttatatcatacttggagaaatttcagctgctcggacccattggaaaattcaagcagcaagtag

SEQ ID NO: 3663 - DNA, 696 bp, Glycine Max; identical to SEQ ID NO: 511

SEQ ID NO: 3664 - DNA, 1284 bp, Glycine Max
atgtatggaaaagtggttctctcgttcatcttcgtgctcttgctcgtcttctcttactcaattttcattggcaccctcgacattcgatcttatttcttccctcgcctaaagttacccgcggctgcacctgctccctgtgcacccgagcctcctcttcgggttttcatgtacgatctccctcgccgattcaacgtcggcatgattgaccgccggagcgcgtcggagacgcccgtcaccgttgaggactggccggcgtggccggtgaactgggggctgaagaagcagcacagcgtggagtactggatgatggggtcgctcctcaacgccggcgagggcagagaagcggtcagggtttcggatccggaactcgcccaagcgttcttcgtgccgttcttctcgtcgctcagcttcaacacgcacggccacaccatgaaggatcccgccacgcagattgatcgccaattgcaggttgatttaatggaattattaaagaaatctaaatactggcagaggtctggaggtagagaccatgtatttcccatgacgcaccccaatgcctttaggttcctacgaggtcagttgaatgaatcgattcaggttgttgtggattttggtcgctatcccaggggcatgtctaatttgaacaaagatgtggtgtccccatatgtgcatgttgtggactcttttacagatgatgagcctcaagatccatacgagtctcgctccacattgcttttcttccgagggagaacttacaggaaggatgaagggattgtccgtgttaaactagcaaagatattggctggttatgatgatgttcactatgagagaagtgttgctacagaagaaaacataaaagcgtcatctaaagggatgcgttcatcaaagttctgtttgcatccagcaggagacacaccatcatcttgtcggctttttgatgccattgtgagtcactgcgttccggtcattgtgagtgatcaaattgaactcccatttgaggatgatattgactactcccagttctcggttttcttctctttcaaagaggcattacagcctggctacatgattgatcaacttcgtaaatttccaaaggagaaatggactgaaatgtggaggcaactcaaaagcatctcccatcattatgaattcgagtatcctccaaaaagagaagatgctgttgatatgctgtggagacaggccaagcacaagcttccaggggtcaaactttctgttcatagaaaccggaggttaaaaatcccagattggtggcagaggagatga

SEQ ID NO: 3665 - DNA, 582 bp, Glycine Max
atgtatggtagcaggagtacgatgagtgtaccggtggatgaggcccaattcctatccattcttctaaaaatcatgaacgcaaagaaaacacttgaaattggagtattcacgggttattctcttctttctacagctctcgctcttccttctgatggcaagataataggaattgatgtcgacagacaagcgtacgagactggattgcccttcattcagaaggcaggagtggagcacaaaattgactttatccaaacggatgcattatctgccctccatgatcttataaatggcaaacatgaagaaacatttgattacgtgtttgtggacgctgacaagaaaaattttataaagtatcacgagctgctgttaaaattggtgaagaaaggtggaataattgcatatgacaacactttatggcttggtacggtggctatgtctgagaacaaggataaaattgaagatagcttatggcaaaatagggagcctacactcgaattcaacaactatatagcaaatgatactcgcattgaatcaacaattctgtcgatcgcggatggtgtaactctttgccgatgtctttaa

SEQ ID NO: 3666 - DNA, 1311 bp, Glycine Max; identical to SEQ ID NO: 512

SEQ ID NO: 3667 - DNA, 1775 bp, Glycine Max; identical to SEQ ID NO: 513

SEQ ID NO: 3668 - DNA, 930 bp, Glycine Max
atgtattccttaacatgcacaccactttcttcttcttcttattctcatcacaccactctaaagccaaacctcaaccctcttctgggtgcagatgcaacttctaggccatgttctctacccttgaaaagaagaacatgctttactaccaaagccattctctcatccaccagagaagatgtcttgaagcatttcaacgaacgacgagctctcaagattatctcaggcttgcagaatttcaataaagacaatgttgcctcggttgtcactgctgcagacaagggtggagcaactctcgtggatatagcatgtgaccctgagttggtaaagctggccattgacttaacttcttgtccggtttgtgtttcttctgtagatcctgcaacatttccagctgcagttgaagcaggagcactaatggttgagattggaaactatgattcattctacgagaagggaataattttcactccagagaagattctaggtctaacaaaggagacaaggaggatacttccatctgtagtcttgtctgttactgttcctcacacactaagcctccctgatcaggtcaagcttgcagagtcattggaacaagaaggtgtagatatcattcaaactgagggaggaaaatgttctaatcccacacaatctggtgttatgggtttgattgagaaggcaacgccaactttagcagcagcgtattctatatcacgcgctgttaagatccctgtcatgtgctcttcggggttaagcactgtcacagtaccgatggctataacagctggagctgctggtgtgggtgtaggctctgcagttaatagacttaatgatgtggttgctatgattgctgaggtcagaagcattgctaattcattgcagacaccatttcagatatccactgcacatgaagtggaaactcaaagacagtag

SEQ ID NO: 3669 - DNA, 156 bp, Glycine Max
atgtattgtccctcttgtttaggtaattattatatcctttcaatgggtttgatgaacaataatagtttgggacttgggagtgtaaagaggctcatggattgggaattcttgcaccttgaattttgttgtacaggttcatatttttctatcgaataa

SEQ ID NO: 3670 - DNA, 2043 bp, Glycine Max
atgtcaaacctcacaagcccggttgcagtttccttaattttgaaaagtttgatcaaaacatccattagtgctcaaaataacaacaccaaacacgaagagtgtagccagccatacagctgcggacagtattccatatactaccctttctggggagggatcagacccaattattgtgccagcaatgaccaattgaagctccaatgcgagggtaatcaaaacaccaccattcaacttggttcacaaagtttccaagtgcttcactttgatgatccagtgcattacaccttgaccatggttcgaacaggcctcatctatgatcattgttcttcctcggccttaaccaacacttccttcaactcgagtctctttcgttactcgcaaaatgttaccaacatcaccatcttctatggttgtcctagctccgtgtttgcgaataggaattactcttttccatgcaaggaagatcacaatatgagtgctttctatggggaccccgaaactgcaagagttcaagactgtgaaggacctaggattgaagtgcaagtatcaaaggaacctgtgcttggtgaaggaattgaagggctgaacaaagctttgagtgaagggttcagagtgcatcttatttcagaggctcaagttcaacagtgcttagaatgcgttgtaagtaatggaacatgtggggctaatgatgagtctcagtttacatgtttttgccaggatggaactgaagctacattgatgaaaatttctcataaatgttatcactccacaacatgctctcattcctctttatattctatgtttactgtctcaggtaataaatggaattgggaaaggaaggttggtataggcgtttctgctgctgtgctcggggcaattgtagtcagcattggcttttatatctgtagtcgtcagaagaagaagaaaaatcttcatgcagtatcatcatctgtacaatctaaagaaacctcttatagttcttctatagaagatactgagaagggatgcacatactttggagtccatttcttcacttatagtgaacttgaagaggccaccaacttctttgatcctgccagagaactaggagatggaggatttggaactgtgtattttggcaaacttcacgatggacgtgtagttgcagtgaagagaatgtacgagaacagttatagaagagtggagcaattcgtgaatgaagtagagatcctaacaggcctacaccaccaaaacctcgtgtcactgtacggatgcacatctcgacacagcagagaacttctgctcgtatacgaatacattccaaatggaaccgttgctgatcacctccacggccaaagagcgaaacctggcacacttgcttggcacacaagaatgaacattgccatagagactgctagtgcactggtgtatctccacgcctctgaaatcatccacagggacgtgaaaacgaataacattctcctcgacaatcacttcagtgtgaaagtagcggattttggcctctcgcgtctcttgccaacgcacgccacacacgtttccaccgcgccacaagggactccaggttatgtggatcctgagtacaatgagtattaccaactcactgataagagtgatgtttatagctttggagttgtgttgattgagctcatatcatcgatgcctgcggttgatatctcgaggcgtaggcatgagataaacctgtccaatatggccattaagaagatacaaagtggggcattgcatgagattgtggacactactcttgggtttgagacggatttcaaggtgaggaaaatgatcagtgctgtggctgagttggcctttcagtgcttgcagagttcaaaagatgtgaggccctctatggcagaagtgttggataggctagaggatattagaagtgatgggagtcataggagcaagcatgaggtgctagatatatcagaagatgatgctgctttgctcaagaatgtgcctcctccaccttcacctgattcacatttggtgaccatttctaattctacaccaccaaatgatagccagtga

SEQ ID NO: 3671 - DNA, 999 bp, Glycine Max
atgtcaaagttaagcattctcttcctcctagtcttatccttcagttctgtactctcagaactatgcaacccacaagacaaacaagccctactccaaatcaagaaagatcttggaaacccaaccactctctcctcatggcttctaaccactgattgctgcaacagaacatggctaggtgtttcatgcgacaccgacacccaaacataccgcgtcaacgacctcgacctctccgatcttaacctccccaaaccctactctattcctccctccatagccaaccttccctacttgaattttctttccattagcaggaccccaaccctaatcggtcaaatcccctcagccatcgctaaactcacccaactccgttatctttatatcacccacaccaatgtctccggccctataccagatttcttgtctcaaatcaaaaccttagtcaccctcgatttctcctacaacaccctctccggcaaactccccgcctcgctctcttcgctgcccaatctcgtcggaatcaccttcgacggcaaccaaatctccggcgccatcccggactcgtacggctcattctcgaagcttttcacgtcgatgacgatctcccgcaaccgcctcacagggaagattccggcgacgttcgcgaatctgaacctggcgttcgtggacttgtctcggaacatgctggagggtgatgcgtcggtgttgtttgggacggagaaaaacacgcagaagatacttctggcgaagaacatgcttgcttttgatctggggaaagtaggcttgtctaagaacttgaacggcttggatcttaggaacaaccgtatttatgggacgctacctcagggacttacggcgcttaagtttctgcacagttttaatgtgagcttcaatgatctttgtggtgagattccgcagggtgggaacatgcaacgttttgacgtatcttcttatgccaataacaagtgtttgtgtggctctcctcttccaccatgcacttaa

SEQ ID NO: 3672 - DNA, 642 bp, Glycine Max
atgtcaaatagaggctcatcatggataactctgaaattcagaggtgttgttgatgtaattcgtgccagcagatatcaatcaaactatgttgcactacagagaaacagaccaattgtgtcagctgctagaactgaaagaggttattggatgcaccctggtcagcaattctatagcaccaatagcatcaacccaagcactaatccaaaaggaataaaggatgtgaagcctcaagctgaagctcttgcacctgcttctaaaatcctcaccttctctcattggctaagatgggttttgggcatggtactttctctcttgctacctttctggaaaccttactggaaaaaattacagatagtagaagtggaggcagagtttgtggttgaagaggctgaagcggtggcaaaaatggtagaaaaagtggcaatggtaacagaaaaggtatctgaagatgtagcagagatgcttcctgaggatggtaaattaaggaaagcagctttggtggtagaacgtgcatcaaaagaggcagcacatgatgctcagttaactgaagaattcttacacaaggttgaagaactcaagaatgacctggatgatttagaagcctttgttgaaccggtaattgacaagattgtgaagatgtaa

SEQ ID NO: 3673 - DNA, 708 bp, Glycine Max; identical to SEQ ID NO: 514

SEQ ID NO: 3674 - DNA, 705 bp, Glycine Max; identical to SEQ ID NO: 515

SEQ ID NO: 3675 - DNA, 543 bp, Glycine Max; identical to SEQ ID NO: 516

SEQ ID NO: 3676 - DNA, 660 bp, Glycine Max; identical to SEQ ID NO: 517

SEQ ID NO: 3677 - DNA, 657 bp, Glycine Max; identical to SEQ ID NO: 518

SEQ ID NO: 3678 - DNA, 873 bp, Glycine Max
atgtcaatggctgcgactctcactgctgtaagaattcccactttccaccaacgccatctcagaaaacatttcactgcaccttcttcttccttacgcctcctcaatctcgcaaagatggaaggaagtgagatcagtgagcaagtgggagaggatttgggagcaaagaagaaagtttttgtagctggagccactggtagcaccggcaaaagaatcgttgagcagttactcgcaaagggctttgctgttaaggctggggttagagacgtcgacaaggccaagacaaccctttcatctgccaacccttctcttcaaattgtgaaagctgatgtcacagagggttctgataagctagctgaggccattggtgatgattcagaagcagtagtgtgtgccacaggctttcgcccggggtgggatttgcttgctccatggaaggttgacaattttggcacagtaaacctcgttgaagcatgcaggaaacgtaatgttaacagattcattcttatcagttccattttagttaatggagctgctatgggacaattattcaatccggcttacatctttcttaatgtttttggactcaccttagtagcaaaactacaggcagagaaatatatcaggaaatccggtataaactacacaataataagacctggtgggttgagaaacgatcctcctactggaaatatagttatggagcctgaggacaccctttatgaaggttccatatccagatctttagttgctgaagtggctgtggaggcattggcttatcctgaggcatcttataaagttgtggaaatagtgtctcgccctgatgctcctaaacgcccgtaccatgacctttttggatccataaggcaacaataa

SEQ ID NO: 3679 - DNA, 1260 bp, Glycine Max
atgtcaatggctgctccaagttccctattgaaggtggaggaaatacaaggaagagggaggggaatggttgcatctcagcctcttaaagctggtcaaattgtcctcagagactctcccattctgctgtattcggctttgcccttggtcagacagtctctgtcatcctcctcctcctctgcctccacttcctgcttctgtgatcactgcttcagaatcttgtctccttctttacagggagattcttcatcatccacagttttgtgccccaattgtcgccaccattgtttctgcaattcaaattgtctttcaaatgcactgaactcctcccattcttcttgggtatgtcaagcattatctcatcttagagccaattctctactgcttgaacagccccttgagcaccaagtccaagttaattttcttgttgctgcctacaatcttgccaatatctccccttcagattttcaaattatgctttctcttcagggttctcctgatgattccaccattgctgcagctcagttcctacacccccttatttcatccctctgctcacttgctctcattggccctcagaatggattttctttagaactcacgtctgctattcttgccaaggacaagctcaatgccttcggcataatgcagccattctctgaacatgatgaccagaggtccgtcagagcttatggtatttacccctatgcctccttttttaaccacgattgccttcccaatgcctgcagatttgattatgtggatgctaatccttctgatgacagccataatactgactttattattaggatgattcatgatgttccccaaggtagggagatctgtttgagttatttccctgtgaatgaaaaatattctagtaggcagaagagactgattgaagattatggcttcacctgtaattgtgatcgatgtaatgtggagtcaaattggtcagataatgatagtgttgaagataatgctgaggaagaagaggaggttatggatgaggaccaatgtgaaactatggcagcatcagacactgatgatcatccccatgaagataataacgatttccctcatgcttatttctttttaaaatacatgtgtgatagaacaaattgctggggaactttagctcctttacctccacaaggtgatactccatgtaatgtcatggaatgcaatgtctgtggcaaattgaagagtgacaatacctttgatattgatgaagggcaagatgaagtttccatggaggactaa

SEQ ID NO: 3680 - DNA, 123 bp, Glycine Max
atgtcaattctaattcaagttttgagggtatatacaaacaatttcagtgaacaaaacataatgggaaagtgtaattttgatattgtttacaaagaaggcttgcatgatagaacaaagattgca

SEQ ID NO: 3681 - DNA, 852 bp, Glycine Max
atgtcacactattacaaaatgaaccaccttcattccttagcttacactaccaccactaacctctgtggctcttccctaggttgggattatcacaaccttggagttctcaacgcggacaaaatgtctttaatgccagctatggagggaagtactacaccaccatcactatcatcacctcaacactctgatttctcaactgggtatctcgaagatgctttgattgaatcatgtgagcgttccaaacgtagacgtgtgttaccatgtgctgctgatgaacatagcaagagtttcattgatgaccttgagcagagtttctggaatttcaaccccttatggaaccaaccagtagagaacttcaacttctactgcatgaaccagatagaaaggttttgtggattttcagatgagcatataagcacatcaaggagcgaggaagcaaacattcttctagcagacactaaaacaccggaagagacaatatcagcctctgaatctttaaattcatcctcatcttcatacaaacaaccggtgacatgcaaaaccacagaccccactgttgccccaacagaaaatgatgataccaggaacaagaaggtggtaacaagagtggtgtatccatttgcaatggtgaagccaggaggaagagaaggtgatgtaacattgaatgacataaatgagaggatcctaatgcctcccacaaggccagtgaggcatcctgtaggagactttgcatgtcggccatgcgtgtccgcagagggtccaggcctttcagggaaagcagtggtggcccttactagaattcacacacagggaggaagaggcaccatcactattatcagaaccaaaggctaa

SEQ ID NO: 3682 - DNA, 1011 bp, Glycine Max
atgtcacactcaagcactctctttctcttcctcatagttctattcttcactccagcactctcagaactatgcaacccacaagacaaagaagccctccttcaaatcaagaaagagttcggtaaccctaccactctctcttcctggctcccaacctctgattgctgcaacaacaactgggtaggtgtctcatgcgccaacaagacccaatcttaccgcgtcaaccacctcgacctcaacgaccttaacctccccaaaccctaccctatccccccctccgtaggtaaccttccctacctcaattttctttccatcaccaacaccaacaacctcgttggcacaataccccctaccatcaccaaactcaccatgctccgtgaactccaaatcagattcaccaacgtgtccggcgagataccccattttttgtcccaaatcaaaaccctagaatcaatcatcttccactacaacaacttctccggcaacctccctccctggctcccttctctccccaacctctacagagtctccttagacggaaaccgcatctccggcaccatcccggactccttcggctccttctcggattcactgaagttgatgaccttctccgacaaccgcctcaccggggagattccggcgacgttggcgaagctggactttgatttcgtggacttgtctcagaacatgctggagggtgatgcgtcggtgctgttcgggtcggagaaacacacgctgcagataaatctggcgaacaactcgtttgcttttgatttcggaaaagtaagggtgtcaaagaccttgttgattttgtatcttagtcacaatcgtttatatggggcgctgcctgagggacttacgtcgcttaagaatctgggcacgtttgatgtgagctacaatgaattgtgtggtaagattccacggggtggtaggttgcaaaaaattgatgtttcttcctattctcataacaagtgcttgtgcggatctccgcttccaaagtgcaagcacttatag

SEQ ID NO: 3683 - DNA, 762 bp, Glycine Max
atgtcacttgtaatcccctcatcctctgcagctcctttgcatttttctcaattggagactaacaattttaattcccaccaaaaagtgggcttgggttttaggtctaagggggacgattttgagtcgattaatgacgaatatggggtttccttgagaaggtgcaattatatacaaaagaaacgcgacaattttacatctggagtattgcactaccttggagagggctgctgcaatgggattgcgtgttacaaaagccactttccaaatggcactcctgttcagatatctatagatgtgaccaagaagaaaaaattgaggcttgatgggatcataaaaactgtcatcactcttctttgcaataggtattgtgcgccatctgctgagagcatattctctgagttctcacttttactcactgacaaaccccttgaagaaccagagactattgacaagggtgttatatttggggaagacaaacttacaacctctggaaacagtggtgaggatgatgacgacgatgcacttattgacatggatgatcaactatattttcctccagaacagaaacaaatagacatttcgaagaacataagggacagggtgcatcttgagattacaattaactcagtatatggtcctgggtgcaagggcatgtgcctgaaatgtggtcaaaactttaacactggcaattgcaattgtagcaagcaggaagtacaagaaaaaagctttggcccacttggaaatttgaaagagaagatgcag

SEQ ID NO: 3684 - DNA, 1125 bp, Glycine Max
atgtcagaagaatatgagaggagtgaggaacatgctgatgatgactcttcaatgggatcatcccagaaatgctcatcctttgatttgaatgaagaagctagtagtgaagataacaatgacaacgatgaggggtatgatgaggaagcaaaagacgaaggtacttcaactaataaaagtagcagcataacgaaggaaggaagtaatgaacgaagaggtggcgtgagacaatatgttagatcaaagatgcctcggctccggtggacacctgaacttcatctatcctttgtacatgctgttgaaaggcttggtggtcaagaaagagcaacacccaaattggtgcttcagctaatgaatgtgagaggcctcagcattgctcatgtcaagagtcacttgcagatgtatcgaagcaagaaactcgacgaggctgggcaagcccatcagtccatgaatcctcgtcaacattttaagatgggaaatggtggaattattctagcaagtgattacaacgatcgcagttatttccatggtctcatgcatccctcctccctatcaccttcacaatcaaaagccatcgattcaaggcaccaacaatggtacttcaatagtcatcaaccttatagaagaccaagttactttagcaacgaagttgtctcctcaacaaccttacaaacgcaaggaagatcaatgtcttcaaaccaaattaacctaatggatgctaccagcattgcacccatgaaaccaagccagtttcttgaagagaaaaagtggcctcccttagatattatgaacaaccatcactggaagaaaaggctacctgccaatattagttcaaatagtgggtcgcaacctgttgtacatcaatttggcaccacttcaccatctctaagacctagcgagttgaacttcggaaacaacacaagaatcagctgggaacatctatcaaactccgacgagcatcgtaactattccaacagtttaaagctagaattggagcctctttttcggattaagctcaacaacactaggaatatggcgatcgatcaggcctcaattcctgcaagagctccaactgcacctacagagaagaatattaatttgtgttggaaaatgcatggattaatttag

SEQ ID NO: 3685 - DNA, 1152 bp, Glycine Max
atgtcagatcacaaccacgagatatccacttccgctgatgatggtaatgattctctgaatggtcacatcatatctactacagttggaggaaaaaatgggaagcccaaacagactaaaagttatatagcagaacgcattgtggggactgggtcatttggaattgtcttcctggctaaatgcttggaaactggcgagccagtggccattaagaaggttttacaggacaaaagatataaaaatcgtgagctacagttaatgcgcttgatggaccatccaaatgtgatctctctgaagcatcgtttcttttccactacaagtgcagatgaactttttcttaatttggtgatggaatatgttccagagtctatgtatcgagtctcaaagttctatagtaatactaatcagagcatgccacttatctatgtaaaactttacatgcaccagattttcagtgggctggcttatatccacactgttcctggagtttgccacagagatttgaagcctcaaaatatactggttgaccctcttacacaccaggttaagatatgtgattttgggagtgcaaaagtgctggtcaaaggaaaagctaatatatcacacatatgttcacttttctatcgggcaccggaacttatgtttggtgccactgagtatactacttcaattgatatttggtcagctggctgtgtccttgctgagctgcttttgggccagcccttatttcctggcgaaaatgcagtggaccagcttgtagagattatcaaggttcttggcacacccgctcaggaggaagtttcctgtacgaatccaaactacaatgatttcaagtttccacagatattccatgaaaaaatgcctccagaagcaatagatcttgcttcccggcttctgcagtattccccaagtcttcgatgtactgcgctagaagcatgtgctcacccattctttgatgaactccgtgaacccaatgctcacttgccagatggtcgtccatttccccctctattcaacttaaaacaagagttatctggagcatctccagaacttattgataagttgatacctgaccatgtgaagcggcagatagggctacaacatgcccatttggctggatttctggaacatgatgttaagctcggcaaattgtag

SEQ ID NO: 3686 - DNA, 744 bp, Glycine Max
atgtcagctgccgtggccgcttccgctgccgccgctaccatgtcgggttaccaccacaactcctcctcgagacaacaacaacacatagaccatgaattggccttaacaccacaacgagtgtgtgtctctccacctctgagcaggtacgagtcacagaagcggcgcgattggaacaccttcgggcaatacctgaaaaaccaccgaccacctttgactctctcacgctgcagcggcgcgcacgttctggaattcctccgctacctcgaccagttcggaaaaaccaaggttcacgccgaaacctgcggatactttggaaactcccaccctccgggtccctgcgcgtgtcccctgaggcaggcgtggggcagcctcgacgcgctcattggccggctacgcgccgccttcgaggagaacggcggcgcgccggagatgaacccgttcgggacacgcgcagtgaggttgtacctcagggaagtgagggacgcgcaggccaaggcgagaggcatagcttatgagaagaagaaacggagaaaaccacaacaaagtggacatgatcatgatcatgatgcgatgatgatggtgggttctacgagtgatgtgaattattcttcagggtatagtggtggtggtggtggtgcctttgttcctcatcagcaaatgttgtctgattcgaatgggacagcttctacatctgatggggtttcttatttctcatcatcatcccagtgtggtgggtttaattga

SEQ ID NO: 3687 - DNA, 300 bp, Glycine Max
atgtcaggcagaaaagaaacggttttggaccttgcaaagtttgtagacaaaggcgttcaagttaagcttactggtggaagacaagtgacagggactctgaaagggtatgatcaattgcttaaccttgtcctagatgaagctgtagagtttttaagagatcctgatgatcctctcaaaactactgaccagaccagaaatcttggcttaattgtttgtagaggaactgctgtgatgcttgtgtccccaactgatggtacagatgagatcgccaacccctttatgcagccagatgggtcctaa

SEQ ID NO: 3688 - DNA, 342 bp, Glycine Max
atgtcaggcgtagaaaagaaaaggctttcaactgagaaagccagcaaaatagtcatttataaaaaacagaaaaattataataacctcatccaatccaaagattttgatacaaccattataacaattaaccaacaaattagtccatttacagaaccacaaaaaatattcacactatacgtattacccatatatgaaatgacaaggtttcaaaaccacttacttgacatagattgcaaccaaactttttttagagctaatgtcaacactcaacaatattctctactctgtcaagagtcatctctccggttatacgtaataagtttaaaaatcttcattggttga

SEQ ID NO: 3689 - DNA, 237 bp, Glycine Max
atgtcaggggcacaaggagcacaaccaaaggagtcaaaaacagcaacaacatatgagtcagtagaaggaggagagaaccgaacaaggactgacttgctttcaagggaggatcaaggctgcattcaagtggaaaaacttcaggagaaggtccatgatcctgctggcaaaggtggtcctgtctttggtgctggcaaagatgaagacaaacaagaccttggagttactggcacaggctaa

SEQ ID NO: 3690 - DNA, 1089 bp, Glycine Max; identical to SEQ ID NO: 519

SEQ ID NO: 3691 - DNA, 280 bp, Glycine Max
atgtcatctttggtggaaataagtttacaaaggatagtgagtttacaaagacaatttctttggggaggtggcttggagggaaataagttggcttgggtcaaatgggaaaagatttgtacaactaaagaggctggcgggcttggcataaaatttttgtggcttttcgattggcgggaaaagcttcattttggtggaaggatatatcatcaaggtaaccgaaggagagtgtggttgaaaataacttggctggacatgtgggtaaggaatgctatgctgagat

SEQ ID NO: 3692 - DNA, 1023 bp, Glycine Max; identical to SEQ ID NO: 520

SEQ ID NO: 3693 - DNA, 1656 bp, Glycine Max; identical to SEQ ID NO: 521

SEQ ID NO: 3694 - DNA, 1635 bp, Glycine Max; identical to SEQ ID NO: 522

SEQ ID NO: 3695 - DNA, 1239 bp, Glycine Max
atgtccaacaggttttgcaagttctatgcccgtggagcatgtttgaagggggatcaatgtgattttgctcatgagaaaaaggatgatatttgcagctattatcagaaaggattctgtgcatatggtagtagatgcagatataagcatgtcaaagcttcccaaccgtcatcttcagcaaatggacgccattctcctgttttggatcctgtggctgtgaatactagtagtgctataccatctgaacatttgttttgtgcatttgctgctgccaactgcccccttgaagataaatgttctcgcattcatggaaatcagtgcttatactgtagaaaattttgcttacatccttctgattggaaggaaaaagaaaatcatttgaggacttgtgagaaaaagggaaaataccttaaggctttggaagatagtcaagaagtagagtgcaatgtttgtttggaacgtgttctgtccaaacctaaaccagctgattgtaagtttgggctgcttcctgaatgtgaccatgctttctgtttatcctgtatccgcaattggcgtaatagtgctgccccaacatctggaatggacatcggtaatgctggcactgctaatacagtcagaacctgtcctgtttgtcgcaaactatcatattttgtcattccaagtggtatttggtattctactaaggaagaaaaacaggaaattatcaacaactacaaggcaaactgcaaattaattgattgcaagcattttaactttggaaatgggaattgtccattcggggctagttgcttctacaagcatacagtgaagcctggctcttacacatggatacatcacaggccaccacctcagtgtagacagaaccattttgatatgtatgacatgttggacatgctccaagatgttgacttaacaagtgcagaatatttttccatcatgaggggttcagacttttttgatgatatggatccatttgagatgatggatatatctcataggcttgctggtgactcaggtccttgtttaggtctttttgattctgatgaggaggacttggatatttttcagatggctgcattgtcggaagcgcttgcttctggtgtggatgattttggtcccgaagatattggtaatgaagatttcaatcctatggaggctgccttgttaccaatgatgatgcattctaatatggaagatgaagatgatgatgaggaagaagaatacagtgatgaagactactag

SEQ ID NO: 3696 - DNA, 987 bp, Glycine Max
atgtccatgtcctttctctttacctttaccatcatcatcagctttggcttgtgcattctttatgcatctgcagaactccagagattatcacactcttccaaacatgatggtgctcttagcttcttggtgcttggtgactggggaagaagaggcgcttacaaccaatcacaagtttctttccagatgggaaaggttggagagaagcttgatatcgactttgtagtttccactggagacaacttctatgacaatggactaactagtgaccatgacaacgcgtttcaagagtcattcactcaaatttacacagcaaaaagcttgcaaaagcagtggtacagcgtgttaggcaaccacgactataggggtgatgcagaggcccaattgagcccggtccttagagaaattgatagcagatggctttgcttaaggtcctttattgtagattcagagctggttgagattttctttgtagacaccactccttttgttgaagagtacttcactgaaccacaggaacacaagtatgattggcggggcattggcccacaaaaaccttatattactaacttactcaaggacctagaattggcactgagggaatcaacagcaaaatggaagattgttgttggtcatcatgccattagaagtgttgggcatcatggtgatactcaagaacttataaatcagcttctccctatccttcaggcaaataacattgacttctacatgaacgggcatgatcattgtcttgagcacattagtgacacggagagccccattcagttcctgactagcggggcagggtcaaaggcttggagaggagacattaaaggaatgaaccgaagagacgtaaatttcttctatgatggacaaggcttcatgtctgtgaaattgactcagacggatgccaccattgagttctatgatgtttttggcaacgttttacacagattgacttcttcaaaacagctacattcttctatgtaa

SEQ ID NO: 3697 - DNA, 720 bp, Glycine Max
atgtccatgtcctttctctttacctttaccatcatcatcagctttggcttgtgcattctttatgcatctgcagaactccagagattatcacactcttccaaacatgatggtgctcttagcttcttggtgcttggtgactggggaagaagaggcgcttacaaccaatcacaagtttctttccagatgggaaaggttggagagaagcttgatatcgactttgtagtttccactggagacaacttctatgacaatggactaactagtgaccatgacaacgcgtttcaagagtcattcactcaaatttacacagcaaaaagcttgcaaaagcagtggtacagcgtgttaggcaaccacgactataggggtgatgcagaggcccaattgagcccggtccttagagaaattgatagcagatggctttgcttaaggtcctttattgtagattcagagctggttgagattttctttgtagacaccactccttttgttgaagagtacttcactgaaccacaggaacacaagtatgattggcggggcattggcccacaaaaaccttatattactaacttactcaaggacctagaattggcactgagggaatcaacagcaaaatggaagattgttgttggtcatcatgccattagaagtgttgggcatcatggtgatactcaagaacttataaatcagcttctccctatccttcaggtaactaaaagctga

SEQ ID NO: 3698 - DNA, 636 bp, Glycine Max; identical to SEQ ID NO: 523

SEQ ID NO: 3699 - DNA, 1959 bp, Glycine Max; identical to SEQ ID NO: 524

SEQ ID NO: 3700 - DNA, 213 bp, Glycine Max
atgtccgtaatctttcagagaggatttgtacatacattgtttcctggagtccatgctcttatgccggttttctcactatctgaaaattttcatattctatttgcatgcagaagctgggacagtggaaagagattgccatattcgtttcacttttataatgtgtacttatttgcaaataagtgtgcacttgcgtatgaaagaaatagcaattga

SEQ ID NO: 3701 - DNA, 177 bp, Glycine Max
atgtcctctatctttccacctgagttgctccaccattacatcaatggtccgatgaggaaatacttcaacactaagttgcggtgcgctcatgaaagtacccatagttgctgtgaagcacgtctcggaaatccaatcatacgaacagtgatgcaaaggagtagtatcgtctcgtcgtga

SEQ ID NO: 3702 - DNA, 2982 bp, Glycine Max
atgtcgaaaactccgaaggagaaggaaacggaggagcctctgccagaccacctccgctgcgggcgcacggacgggcggcaatggcgttgccggcggcgagtgaaggagaatctgaagctctgcgagattcactacctccaaggtcgccaccgccagtacaaggagaaggttcccgagtcgctgaagcttcagcgcaagcgcaaatctaacaacaacaacaacaacaacaacgaggaagaagaagaagaagaagaagaagagaaaccagagcctgataagaagaataagaagcgcatgctttctgaggattccgatgcttcagcttcttctcctccggcgaggaagaaggcgctgaagcagggcgatatgcagttggagctcttgaggatggtgctgaagagagaggctgagaagaacaaaaacaagagcaagagcaagaacaagaagaacaataacaaaaagaagaataagaagaaggaaaagaggaggaaggaggaaaaagaggaattgtgttacactaaagaagagttgagaagagaattgccaaatggagtaatggaaatctctccggcttcaccgacgcgtgattacaacaatgtaggttcgcattgtgatgtcaaagttggtgttgatagtaaaactgttactccgcgttactttaggtccaagaatgttgatagagtccccgcggggaagttgcagattgtgccgtatggatcaaacttgaaaaagggtaagaggaagaagtgtcattggtgccagagaagtgagtctgggaatctcattcaatgttcgagctgtcagagggagttcttctgcatggattgcgttaaagagcggtattttgacgctgaaaatgaaattaagaaggcatgtccagtttgtcgtggaacttgcccttgtaagtattgctctgcaagtcaatgtaaagacagtgaaagtaaggaatgtttgactggtaagagcagagttgatagaatattgcattttcattatttgatctgcatgctccttccagtactaaagcaaataagtgaagatcagaatattgagctagaaacagaaatgcatttgtgggtgacagggaaaaatatttctgatattcaaatcaagcaggttgaatttggatgcagtgagaaaaactattgcaatcactgcaaaacacccattttggatctccatagaagctgtcctagttgttcatatagcctatgctcaagttgttgtcaggaattaagtcaaggaaaagcttctggagcaatgaactcatccgtgttcaagcgacctgataaaatgaaaccttgcagtgctatattgcctgagtggacaaatggtaatggcattgatagtctatcatgccctcctacagagcttggtggttgtggtaaaagccaccttgagttgagatctgttttcccttccagttggatcaaagagatggaagcgaaggcagaagaaattgtttgcagctatgactttcctgaaacttcagataaaagttcaagttgctcattgtgttttgacactgatcatggtactaacagatataagcagttgcaagaagcagctctaagagaagattccaatgataattacttgttttgtcccacagtgatggacatcagtggtgataactttgagcactttcagaaacactggggaaaaggccatcctatagttgtccaagatgcgctccgaagtacctcaaacctcagttgggatccactgaccatgttctgtacttatcttgagcagagcattacaagatatgagaacaataaaaacttgcttgaatcctgtttggattggtgggaggtggaaattaacattaagcagtactttactgggtctgtcaagcgtcgtcctcagagaaacacttgggatgagatgctgaaactaaaagggtggctttcttcccaaatatttaaagagcagtttccagctcattttgctgaggtaattgatgctctaccagttcaagaatacatgcatcccctctgcggtcttctgaatttagctgcaaatttgccacatgggagtgcaaaacatgacattgggccatatgtctacatttcttatggctctgctgacaaagaaactgattcagtgacaaagctctgctatgactcatatgatgtggttaatattatgacacataccacagatgcccccctctctacagaacaacttacaaaaataagaaaactgctaaaaaagcacaaaactctaaacagagcgaaaaggctcatggagtatggtcgaagaaggaatgaactttttcaggagactaaaaaagtttctagtcagagcatggacagcaatggagaatgtgatttcatttctgattctgattctggatccactttacttctccttgggactgttcaaactgctgaattgtcaaagcacaataatcctagaaatccctttgaaagctcaaaaagacataaaaaaaagtttactgagcatttgggtgcccagtgggatgtctttcgcagacaagatgttccaaagctcatcgaataccttaaaagacattatgctgaattttcttatacccatgactatgacaagaagatggttcatccaattctagatcagagcatttttcttgacagtactcacaaaaagagactaaaggaggaatttaagattgaaccatggacttttcagcaacatgttggacaagctgtcatcattcctgctggatgtccataccagatgaggaattctaagtctagcgttcatgcggtattggaatttgtgtcccctgaaaatgttactgagggtatccagttgattgatgaggtccgactattgcctgaagaccataaagcaaaagcagacctgctggaggtaaagaaaatggcgcttcatagcatgaatacagcaattaaagaagtagttattaaattgattaacttgcgcatctatattttttctttcttctgtgaagtttatgccctaccggaattgaaataa

SEQ ID NO: 3703 - DNA, 1773 bp, Glycine Max
atgtcgaagaagaaagttagcggcaacaccatgacgctgaaggacttccatggcggttcaattccctctgatctccctctaccttctgctcccggcgtgactgtgaggacttcagatcgtgctggttttgatcggccgtcggcgtgggggacaccgatgggccggtcggatcattggtctcggccgcacacgtcgccggcaactaggcattatgatgacaaaaccccgtttttgtcacacactgccccaattggcaggaattttgatgaggatgagaggaagccccttgatggtggttcgatgccacgtaggacaatcagtgatgagagcatccgtggtggtccgcctcctcgtgttgaggtaaggccacctgagtttggactgggaggaagttcattgggcaggcaagtggctccagtgtctcaaactcctgttggggcaggtaattcatactcggggaggctcaccgatgcgggaactgcagcaggtggtggtggttatccgaacgcgtggtcaatgcggaaagaagtggcaagtgctgtcgagccagagcaaccagcttggtctagtgctggtgctgcttccaagttggctcacgccagtgcccttgagaaggtgtcttctggtagatggcagtctaaggctgtaaattatcagactgatgctgaggtggttagatctcctgaagtggagaatagaccacatgacggaggcactagacacgctgaaaggggcttaggcattgataatccgatgcaaggtggtaggaatgagttaccaaattatgaaaggtctggggtttcccgatattcagatgtacggccaacaagtgcacctcatcactctggtggggttcagctggctcgaaatgatggaaaaattgttgggtctgatttgcagcaccctatgccttctgaactaactgagcgacctaaactgaagttgctaccaagggcaaagccagtggaaagttcagaacctgctgtcatggattatgcacagggtaatcgtcaggttaatgattctggccatgttgaaaccgtttatcaagcacatggccatgctaattttgtgaagcctgtatcagctggaaatgacaatgggaaagacgcaggacagcgtccgaagctgaatttgaagcctcggtctcagcccactgaaaagctggatggaaacagtgaaagagacaggaatgttttatttggtggagctcgcccacgtgaactagtattgaaggagcgagggattgatgatgtttcaatcaatgtggtggagcattcaaacagggttgaaaacaatattttgagggttcagaaacatcctgaccattcaacccagactcgatatggtgaaaagaccgaggatgctcatcttgatcaaaagacaggcagaaaacctgaaaggaaggagcaaagggcagatggtgatagggctcatgcgcagaggagaaattggcggggtgatactcggagaaatgggaaggagaccgataggcagccgcatgccccggagaggcaaccttcacctgagacatggcgtaagcctgtggagcagcagctaaaatcagctccaggtgctgctagcacacggtacagtagagcagcttcggcggttgaacttgcacaagcattctccagatctgtatcagatccaaaagtgaatgataggttttcaggtcaaaggggtctgaacactggcaacagcagcaggacacaagttccattttcacggcttgttggtcctacatcaaggcctcagatcaatggttattaa

SEQ ID NO: 3704 - DNA, 1290 bp, Glycine Max
atgtcgaagaagaaagttagcggcaacaccatgacgctgaaggacttccatggcggttcaattccctctgatctccctctaccttctgctcccggcgtgactgtgaggacttcagatcgtgctggttttgatcggccgtcggcgtgggggacaccgatgggccggtcggatcattggtctcggccgcacacgtcgccggcaactaggcattatgatgacaaaaccccgtttttgtcacacactgccccaattggcaggaattttgatgaggatgagaggaagccccttgatggtggttcgatgccacgtaggacaatcagtgatgagagcatccgtggtggtccgcctcctcgtgttgaggtaaggccacctgagtttggactgggaggaagttcattgggcaggcaagtggctccagtgtctcaaactcctgttggggcaggtaattcatactcggggaggctcaccgatgcgggaactgcagcaggtggtggtggttatccgaacgcgtggtcaatgcggaaagaagtggcaagtgctgtcgagccagagcaaccagcttggtctagtgctggtgctgcttccaagttggctcacgccagtgcccttgagaaggtgtcttctggtagatggcagtctaaggctgtaaattatcagactgatgctgaggtggttagatctcctgaagtggagaatagaccacatgacggaggcactagacacgctgaaaggggcttaggcattgataatccgatgcaaggtggtaggaatgagttaccaaattatgaaaggtctggggtttcccgatattcagatgtacggccaacaagtgcacctcatcactctggtggggttcagctggctcgaaatgatggaaaaattgttgggtctgatttgcagcaccctatgccttctgaactaactgagcgacctaaactgaagttgctaccaagggcaaagccagtggaaagttcagaacctgctgtcatggattatgcacagggtaatcgtcaggttaatgattctggccatgttgaaaccgtttatcaagcacatggccatgctaattttgtgaagcctgtatcagctggaaatgacaatgggaaagacgcaggacagcgtccgaagctgaatttgaagcctcggtctcagcccactgaaaagctggatggaaacagtgaaagagacaggaatgttttatttggtggagctcgcccacgtgaactagtattgaaggagcgagggattgatgatgtttcaatcaatgtggtggagcattcaaacaggtaa

SEQ ID NO: 3705 - DNA, 1866 bp, Glycine Max
atgtcgaagaagaaagttagcggcaacaccatgacgctgaaggacttccatggcggttcaattccctctgatctccctctaccttctgctcccggcgtgactgtgaggacttcagatcgtgctggttttgatcggccgtcggcgtgggggacaccgatgggccggtcggatcattggtctcggccgcacacgtcgccggcaactaggcattatgatgacaaaaccccgtttttgtcacacactgccccaattggcaggaattttgatgaggatgagaggaagccccttgatggtggttcgatgccacgtaggacaatcagtgatgagagcatccgtggtggtccgcctcctcgtgttgaggtaaggccacctgagtttggactgggaggaagttcattgggcaggcaagtggctccagtgtctcaaactcctgttggggcaggtaattcatactcggggaggctcaccgatgcggtgcatgtggggatgaatcctccgagtttaggaggtagtaaggagcagggaactgcagcaggtggtggtggttatccgaacgcgtggtcaatgcggaaagaagtggcaagtgctgtcgagccagagcaaccagcttggtctagtgctggtgctgcttccaagttggctcacgccagtgcccttgagaaggtgtcttctggtagatggcagtctaaggctgtaaattatcagactgatgctgaggtggttagatctcctgaagtggagaatagaccacatgttaatgttaatggcgttggtgcctataataggacggaggcagtgggtgaaaaggagtattatgatgcaatgctagctagacacgctgaaaggggcttaggcattgataatccgatgcaaggtggtaggaatgagttaccaaattatgaaaggtctggggtttcccgatattcagatgtacggccaacaagtgcacctcatcactctggtggggttcagctggctcgaaatgatggaaaaattgttgggtctgatttgcagcaccctatgccttctgaactaactgagcgacctaaactgaagttgctaccaagggcaaagccagtggaaagttcagaacctgctgtcatggattatgcacagggtaatcgtcaggttaatgattctggccatgttgaaaccgtttatcaagcacatggccatgctaattttgtgaagcctgtatcagctggaaatgacaatgggaaagacgcaggacagcgtccgaagctgaatttgaagcctcggtctcagcccactgaaaagctggatggaaacagtgaaagagacaggaatgttttatttggtggagctcgcccacgtgaactagtattgaaggagcgagggattgatgatgtttcaatcaatgtggtggagcattcaaacagggttgaaaacaatattttgagggttcagaaacatcctgaccattcaacccagactcgatatggtgaaaagaccgaggatgctcatcttgatcaaaagacaggcagaaaacctgaaaggaaggagcaaagggcagatggtgatagggctcatgcgcagaggagaaattggcggggtgatactcggagaaatgggaaggagaccgataggcaaccttcacctgagacatggcgtaagcctgtggagcagcagctaaaatcagctccaggtgctgctagcacacggtacagtagagcagcttcggcggttgaacttgcacaagcattctccagatctgtatcagatccaaaagtgaatgataggttttcaggtcaaaggggtctgaacactggcaacagcagcaggacacaagttccattttcacggcttgttggtcctacatcaaggcctcagatcaatggttattaa

SEQ ID NO: 3706 - DNA, 5859 bp, Glycine Max
atgtcgaatccggatcagacagtattgaatcggcggccatcaagaagtgccgcgacgacgacgttttcgctggaggtgttcgacaacgacgtcgtgccctcctcactcgcctccatttctcccattctcagagtcgccaacgaaattgaaaccgagcgccccagggttgcttatctctgtaggttctatgccttcgaaaaagcgcacaggctagatcagagttctagcgggcgtggcgtcaggcagtttaagacgttgttactacagcgattggagagggacaatccaactagtcttgcctctcgggctaagaaaacagatgcgagagaaattcaatcttactatcagcaatattatgaacattatgtcagaactctcgaccaagtgaatcaggcagacagagcccagcttagcaaagcttaccagactgctggggttctattcgaagtgctttgtgccgtcaacaagactgagaaggtcgaagaagttgctcctgagattatcgcggctgctagagatgtccaggagaagacggagatttatacgccttacaatattcttcctctggatgctgctggtgcttctgtgcccattatgcaatttgaagagattaaggctgctgtttctgcgctttggaatactcgtggcttgaactggcctaattcatttgagcaacagaggcagaaaactggagatttagacatgcttgattggcttagagccatgtttggctttcagagggacaacgtcaggaatcagagagagcatctgattttgcttcttgctaattctcatataaggctacaccctagacccgagcctttcaacctggcacataaaactgcaatcaagagaactcttgtcaatattacattatcaatctttttttatcgtagctatcagagtagcctgctttgcttttggctagaactcgatgatcgggctgttgattcagtgatgaaaaatctcttcaagaattacaaatcatggtgcaaattcttgggacgaaaacatagtttacgacttcctcaaggtcagcaagagatacagcagaggaagttgctttatatgggcttgtatcttcttatctggggcgaagcatccaatgttcgtttcatgccagagtgtctatgctacatatttcacaatatggcatatgaactccatggtttattggctggaaatgtcagcattgttactggtgaaaatatcaagccttcttatggtggtgatgatgaggcattcctgcgcaaggttataactcccctgtatcaagtaatacaaaaggaagcaaagaagagtggacatggaaaggctccgcactcagcatggtgcaactatgatgatctaaatgagtatttctggtcatctgattgcttttctctaggatggcccatgcgtaatgatggtaattacctcctaaggagctactggcatgattgcaatttactttattttcagtatttgtataaattttgtatcagggaagaaatggtgctgctgcaagaaaatctggaaaaactggcaaatcaaattttgttgagacacgaacattctggcacatcttccgcagctttgaccgtctgtggacattttttatactgggtgatgttcattattgcttgggaagggatttcactgacggatatatttcagaaggatgtcttatataatctatctagtatattcatcacagcatccattctgcgcttgcttcaaagtatcttggacctgatcctgaactttccaggctatcatcgatggaaattcactgatgtgctaagaaatattcttaaagtctttgtcagtcttttttgggttatcattcttccactcttctatgttcattccttcaagggtgcacctcagggtctgaagcagttgctttcctttttcaaacaaataagaggcattccagcattttacatgctggcagttgcattatatttgcttccaaatttactagcagctgttctgtttcttttcccaatgttaaggcgttggattgaaaactcagactggcacatagtcagactcttcttatggtggtctcagccaagcatctatgttggaagaggaatgcatgatagtcaatttgctctcatgaagtacactatattctggttgttgcttttgacatgtaaatttttattcagcttttttgtccagataaaacctctagttaggccaacaaaggacataatgagcattcgacgtgttaattatggctggcatgcattttttcccaatgctcgaaataactatagtgcagtagttgcactctgggctcctgtacttttggtttatttcatggacactcaaatttggtatgcaatcttctcaactttgtacggtggtcttgttggagcctttgatcgtctaggagagatacgcactctgagcatgctaagatcacggtttcagtcattgcctggtgcattcaacacatgcttggttccttctgataagaagcaaaaaggaagattctctttctcaaagaaattttctgagattactgcaagcaaaagaaatgaagctgccaaatttgcccaattatggaatgagattatttgcagtttccgcgaggaagatctcataagactaaactattggccaccatttttgcttgcaagcaagattactgtagcactagatatggcaactcagtttcgagggagggactctgatctttggaagcgcatatgtgctgatgaatatatgaaatgtgctgtgattgaatgctatgaatcctttaaacatgttctacatgatttagtgataggagaaactgaaaaaagtataatttcctccatcatcaaagaagtcgagagcaacatctcaaagaatacacttcttacaaatttccgtatgggctttctaccctccctttgtaagaagttcgtggagcttgtggaaatcatgaaaaatggagatccatccaagcggggtacagtggtggtcttgctgcaagacatgttagaagtggtcactgatatgatggtgaatgaaatcagcgaattggcagaacttcatcaaagtagtaaggataccggacaacaagtttttgctggtacagaggcaaaacctgctatactattccctcctgtggttacagcacaatgggaggaacaggtacttagtaattttatattattattattcaaagatccaaatgcttatataaccaatgaatcattgtggttgtttcagattagacgtctttatctactcttgactgtcaaggaaactgccgttgaagttccaacaaacagtgaagtacgtagaagggtttcattctttaccaattcattgttcatggatatgccacgtgctcctcgagtacgtaaaatgctctcattcagtgtcctaactccatactacagtgaagagacagtatattctaagaatgacattgaggttgagaatgaagatggtgtgtcaatcatgtattaccttcaaaagatcttccctgaggaatggaataacttcttggagcgacttgattgtaagaaagatagtgatatatgggagaaagaggagaatatattacagctacgtcactgggcctcattaaggggacaaacactttgtaggacagttaggggaatgatgtactaccgacgagcaataaagctccaggcatttcttgatatggcttctgaaaaagagatattcgatggttataaagctattgctgttccatctgaggaagaaaaaaagagtcatagatccttatatgcccgtttagaggctatggctgacttgaaattcacatacgttgcgacctgtcagcaatatgggaatcagaagcgctctggggaccgtcgtgcaacagatatcctgaatttgatgcaatccctcacttcgtgtggaaaagtacagaaagtttattattctgtattggtcaaagctgtggacaatcttgaccaagaaatatatcgaataaagcttccgggcccagcaaagttaggagaaggaaagccagaaaaccaaaatcatgccatcatttttactagaggggaagctcttcaggctatcgacatgaaccaggataattatttggaagaagctttgaaaatgcgtaaccttctggaagaatttaatgaggatcatggagtgcgcccccccaccatattaggtgttcgtgagcatattttcactggaagtgtctcttccttggcctggtttatgtcaaaccaagaaactagctttgtcactattggtcaaagagttcttgctagaccactaaaggttcgattccactatggtcatccggatgtttttgatagaattttccattttacccgtggaggaatcagcaaggcttcttgtggcatcaatctgagcgaggatatatttgctggattcaactcaacactaagacgtgggaatgttactcatcatgaatatatccaagttggaaagggtagagatgtagggctcaatcaaatctctctttttgaagcaaaagtggcctgtggtaatggagagcagatactaagcagggacatctacagactggggcatcgatttgactttttccgcatgctatcattttactttacaaccgttggattttatatcagctcaatgttagtggccatcacggtatatgctttcctctatggcagattttacctgtcattgagtggattggaggaggctataattaagatagccaggaaaaagggagatgatccattaaaggcagcaatggcttcccaatcccttgttcaaataggtcttctgatgactcttcccatggttatggaaattggactagagagaggattcagaactgcactaagtgacatcataataatgcagctgcagctagcacccgttttcttcactttctcactagggactaagatgcactattttgggcgcactctcctgcatggaggggcaaagtacagagcaactgggcgtggttttgtagttcgtcacgagaggtttgcagataactacaggatgtattctaggagtcactttgtaaaagggatagagatttctatactgcttatatgttatgggctttatggatcagcagctcctgattcaacagcatatgcccttctctcagtatcaatgtggtttttggcatgttcttggttgttcagtcctttcctttttaacccatcgggattcgagtggcagaagattgttgaggattgggatgattgggcaaaatggataagtagtcgaggtggtattggtgttccttcaattaagagctgggaatcatggtgggatgaggagcaggaacatctgcagtacactgggatttgggggaggatttgggaggtcattcttgccctgcgtttctttgtctatcagtatgggattgtgtatcatctacatgttgctagaggtgacaagagtatcggggtttatggtctgtcctggttagttgtagtggctgtcatagtcatcttgaagatagtgtccatggggagcaagacattcagtgcagatttccagctgatgtttcgtctcctcaaaatgtttctgtttattggaaccattgtcattctaattttgatgtttgtcctacttagtttcacagttggtgacatctttgcgagcctcctagcctttatgcccacaggttgggcatttatacagatagctcaagcatgtaagccattggtgaagggaattggaatgtgggggtctatcaaagcgttatcaagagggtatgaatacgtgatgggagtgattatctttgcaccagtggccataatggcttggttcccttttgtttccgaattccaaactagactgctatacaaccaagctttcagccgagggcttcaaatccagcgcattctggctggtggcaagaagaataaataa

SEQ ID NO: 3707 - DNA, 1842 bp, Glycine Max
atgtcgaattggatctcctccaaacttaaagccgcagagaacattctccaccagatcgatcagcaagcggctgaatcgcttcgcaagaacgaggattttcggttggaggaaccgagcattgatgctcccttcaaatcagggagcggtgtgtctctgaaggatcaattgaagaagaagccattagagagcaatgagtatcgtggaaaattgcgcagtgatcccaattttgatgggcttaaagctacagcaagtgcacccaaactatctcccaaatctggccctaccctaacagatgatgattggactgaactcctaagtgcaccatcacctactcagtctatagcttctgcttctgggggcaatcacggtaatgggttacctgcaccgcgtggtttgggcagaagcagtagtaggaagcagaagggtttgtcttcagggtcattggcgacagatgtaaaaaggaatccaagaactggtaacagtggtctgaggtccttgcagaagtcggactctgtcaaagaagttaaattgagtagaaaagccagtgatgatgggaaggaatctacctcttcgacttcgacggggaggaattttgctgttgaatcggagaccgatggtaaatggggtaaaggactggagcatgaacttaattcaatatctgatgatttgaaaaggggttctcctgtggctagtgatggaatttctgattcagatacagattctggttcaacatctgattctgaaagtgaacatgagagggaggaaaggagaaagaggagggaaaggattctggctgagaaagtagcagctaaagcaataaatgctatcaaggagcgggagaatatagtggccaaattagagggggagaaggaaagtctagagaaaatacttgaggagcgagctaaacaacaagcacaagaggcttcacagcttcagagcactatgatggaaacaatggaagctgttgagttagaaaagcagaaacataataatactagaatggaagttcttgcacgtttagctaaactggagactgtcaatgctgatcttgcaagatcccttgcagctgtgcagtggagccttgaagttgaggttaagcaagtatcagaactcagacagcaaatcagttcgaaagagttgtttcacgaagaactcagaaggcgaatgaagaatcctcgtcaaactggagcttcacaaaatcaactagtttcaaaaagcgttgagttggaacgggaaatccacgaggcagagcactctttaattaataataaagttgcacagttgcaggaaaaggcaaggaagctagaagctgatattgaaatgacaaggaaggagatagaagagccaacagaagtggaagttgagctcaagcgaaggcttcaacaaatgactgaccatttaatacagaaacaagcaaaggttgagtcactctcttctgagaaggcaagtcttgtattcagaattgaggctgtctcaaggttgctggatgagaacatgtcagcatcaggtgcagcaaacatgaatcctgcctcttcatcaagtgacttagaatcaggattgtgggagctctccaattcaaagttgaagcctatgctaaaagccagaattcattctggcaagatacagcttggatcattgcttcaacaacttgattatatttttgtgactggagcactttttctgaaaaggaactcaacggcaaaattgtgggctttgatatatcttgtttgccttcatttctgggtgttttatattcttttatcacattctagcccatcaaatgagggtagatctggtgcccagatctcactggagaacattaataacactggtggagtatga

SEQ ID NO: 3708 - DNA, 2685 bp, Glycine Max
atgtcgaattttctcaaatccctcactccaccgccctcgggctggtctgaaacaaccccattctgccaatggaagggtatccaatgcgattcatccagccacgtgaccagcataagcctcgcttcgcattccctcaccggaacactcccctcggatctcaattccctctctcaactccgcactctctccctccaagacaattccctcaccggcaccctcccttctctctccaacctttctttcctccaaaccgtctacttaaaccgcaacaacttctcctccgtgtcccccaccgctttcgcctccctaacctccctccaaaccctcagcctcggctccaaccctgctctccaaccctggtccttccccaccgacctcacttcctcctctaacctaatcgacctcgacctcgccaccgtatccctcaccggtcccttgccggacattttcgacaaattcccttcccttcaacaccttcgcctctcttacaacaacctcaccggcaatttaccctcctctttctccgccgccaacaatctcgaaacgctctggctcaacaaccaggccgccggcttgtccggtaccctcctcgtcctctccaacatgtctgcattaaaccagtcctggctcaataagaaccagttcaccggttccataccggatttatcgcaatgcacggctttgtctgacttgcagctcagggataaccagttaactggtgtggttcccgcttcattgacaagtcttcctagtttgaagaaagtttctctggataataatgagcttcaggggcctgtgcccgtgtttgggaaaggtgtgaatgttactctcgatgggattaatagtttttgtcttgatactcctgggaattgtgatcccagggtgatggttttgctgcagattgccgaggcattcgggtatccaattcggtcggcagagtcgtggaaggggaatgatccgtgtgatggttggaactatgttgtgtgtgctgccggaaagattattactgtcaatttcgagaaacagggtttgcagggtaccatctcccctgcatttgccaatttgactgacttgaggactttgtttctcaatggcaataatttgatcggttctatacctgatagtttgatcactttgcctcagcttcagactcttgatgtgtctgacaacaacctctctggattggttcctaagttcccaccaaaggtgaagttggtgactgcgggaaatgctttgcttgggaaaccccttagtcctggaggtggaccaagtggaactactccttctgggtcttcgaccggtggaagtggtggtgaatcctcaaagggtaattcttcggtgtcgccaggttggattgctggtatagttgttattgtgttgttttttattgcagtggtgttgtttgtgtcttggaagtgttttgtcaacaagctgcaggggaagttcagtagggttaaaggtcatgaaaatgggaaaggaggctttaaacttgatgctgtccatgtttctaatggatatggtggtgttccagttgagttgcaaagccagagcagtggtgatcgcagtgaccttcatgctttagatggtccaacattttctatccaagttcttcgacaagtgacgaataatttcagcgaggagaacattttaggcaggggagggtttggagtagtttataagggggtgttgcatgatggaacaaaaattgctgttaagaggatggaatctgttgcaatggggaacaaaggtcagaaagagttcgaagcagagattgcacttcttagtaaagttaggcatagacatttggttgctcttctagggtattgcatcaatggcaatgaaaggcttttggtgtatgagtatatgcctcaaggtacattaacacagcacctgtttgagtggcaggagcatgggtatgctcctttgacttggaagcaaagggtagtaatagctttggatgtagcgcggggggtggaatacttgcacagtttagctcagcaaagcttcattcatagagacttaaaaccctcaaacatactactaggcgatgacatgagagcaaaggttgctgattttgggttggttaaaaatgcaccagatgggaagtattctgttgagacacggttggctggaacatttggatatcttgcacctgagtatgcagctactggaagagtgacaaccaaagtggatgtttatgcatttggagtagttctgatggaacttatcaccggtagaaaggcattggatgatactgtgccagatgaaaggtctcacttggtgacatggttccgtagggtactaattaacaaggaaaacattccaaaggcaattgatcaaattctcaatccagatgaggaaaccatgggaagcatatatacagtggccgagctggcaggccattgcactgctcgcgaaccataccaaaggccggatatgggtcatgcagtgaacgtcttggttcctcttgtggagcaatggaaacctactagccatgatgaagaagaggaagacggctctggcggtgaccttcatatgagccttcctcaagctctacgaaggtggcaagccaacgaaggcacttcctcaatatttaatgacatttccatctcacaaacccaatcaagcatctcctctaaacctgcagggtttgcagactcctttgattcaatggattgccgttaa

SEQ ID NO: 3709 - DNA, 1215 bp, Glycine Max
atgtcgcgttgttttccatttccaccaccaggatatggaaagaaggctataacagatgaagtggacttattagaaaaggaaaagcagaaagaaaaaaaacataagaaagataagaaggacaaagagaagagggaaagcaaggaaaagagagagaaagaaggaagagatgggaagcataaggaaaagaaggacaaaaaggaaaaacacagagagaaaaagaaagataaggataaagacaaggacaagagcaaagatagagataaaagtaaaagcagtactgcagatgacaaagggttcccaagacaagctgagggtctcaacgcaggtaaaccccatcaaaaggaaattaagcaagacaataagaagggtatcttgtttgagaacagactcaccaaacagtatgctggcaacaatggggagaaggctagagagaaaaatcatctggctgaagagaacaaggattcaaagttcctcctggagttggatcggaggattaaggatgatgatggaggagctaaccatcaattggttcataaatttacaaatacaaaccatagaaaagatgaggggactgttaggttggtggctaaaggtggtggcaccaggtctgatggtaatgaaaaactcaaggatatgggtcttgatgttaagaagattgatgggcgaggaatacaggatgaggtccggccaattggaaatgcagcaccagttcagaatcatgttggaaattttcatcctagagttgatggaatacccaaactattgggaaagtattttgaaaggaatttggaagcaacagttgaaggtaaagaaaaggttaaggaaaagaaagatgaaaaagaaaaggccaaggaaaagacagaagaaaggaaggttaaggaaaagaaagatgaaggaaaggaaaaggttaaggagaaaaaagatgataaacgaagagataaaaggaaagataaagagaaggagaagaaagggcatgggaaggacaaagacagggataaagagaagaaaaaggaggagaaagctaaggagcatggtgaacttaaaacaacagagcaaaataaattaaaagaaagcaacaaagttggacttataaattcaaattctttcgcacagccttctaggaacagccatgggaacactgtcagtggagaaaatcgtaagaagcggaaggacattgagtcaaatggagttccacatggtgagtgttacttatga

SEQ ID NO: 3710 - DNA, 1698 bp, Glycine Max
atgtcgcgttgttttccatttccaccaccaggatatggaaagaaggctataacagatgaagtggacttattagaaaaggaaaagcagaaagaaaaaaaacataagaaagataagaaggacaaagagaagagggaaagcaaggaaaagagagagaaagaaggaagagatgggaagcataaggaaaagaaggacaaaaaggaaaaacacagagagaaaaagaaagataaggataaagacaaggacaagagcaaagatagagataaaagtaaaagcagtactgcagatgacaaagggttcccaagacaagctgagggtctcaacgcaggtaaaccccatcaaaaggaaattaagcaagacaataagaagggtatcttgtttgagaacagactcaccaaacagtatgctggcaacaatggggagaaggctagagagaaaaatcatctggctgaagagaacaaggattcaaagttcctcctggagttggatcggaggattaaggatgatgatggaggagctaaccatcaattggttcataaatttacaaatacaaaccatagaaaagatgaggggactgttaggttggtggctaaaggtggtggcaccaggtctgatggtaatgaaaaactcaaggatatgggtcttgatgttaagaagattgatgggcgaggaatacaggatgaggtccggccaattggaaatgcagcaccagttcagaatcatgttggaaattttcatcctagagttgatggaatacccaaactattgggaaagtattttgaaaggaatttggaagcaacagttgaaggtaaagaaaaggttaaggaaaagaaagatgaaaaagaaaaggccaaggaaaagacagaagaaaggaaggttaaggaaaagaaagatgaaggaaaggaaaaggttaaggagaaaaaagatgataaacgaagagataaaaggaaagataaagagaaggagaagaaagggcatgggaaggacaaagacagggataaagagaagaaaaaggaggagaaagctaaggagcatggtgaacttaaaacaacagagcaaaataaattaaaagaaagcaacaaagttggacttataaattcaaattctttcgcacagccttctaggaacagccatgggaacactgtcagtggagaaaatcgtaagaagcggaaggacattgagtcaaatggagttccacatgtcaatgacagtttgcccaataagtttccaaaattgtcttcctctcatccattcaatgaaaatggaagggtatgggaaccttgccaagtatccattccaaatgcttcagataggccacgagaagccaccagtgttaaggtagaaaagaaagaaagcaagataaatgggatcattgaaagtaagccatttgcagcttcttcaatcaagactcccactgccactgtgccagctactttggtaactgaagcatctgcaaagccaccccatccagataccaagtacttaggccaggtatattcagtacctaaggtggagcagtggtctgattttgatgatcaagagtggctatttgacaccaatgtttcacaagaaagaaaatctgtggtgaaatcttcaatagaggttggggagacacctcaggtatgggcagaagctctgcgcatagagcccgcagatgtttttgctcttccatacggttggggtccacttggtaatagttaa

SEQ ID NO: 3711 - DNA, 1698 bp, Glycine Max; identical to SEQ ID NO: 3710

SEQ ID NO: 3712 - DNA, 390 bp, Glycine Max
atgtcggatccgtacgagcgggtgaaaggaggaagattagcattcaaaggaggaatccttgccagtcgctccaaatccattgacaaaaaggggaagaagaagaagaagaacaagggcaaggacaacgacaacaaccctaaccctaaccctaaccctgaagaacaggaactggaacaggaacagaaacaggagcaggaagaaacccccctcctcgaggacgagggcgagggatctgaatacaccatcgatgcggccaagcgtatgaagtacgaacaactgttccctgtcgaagccaagaagttcggttatcaacccaaaaccaacttcaagtcagttgaggatgccctcgatgatcgcgtcaagaagaaggctgatcgctattgtaaatag

SEQ ID NO: 3713 - DNA, 363 bp, Glycine Max
atgtcgggattcagagacgctcgctgttttccgcgtccaatcctcgctgtgaatctcgccctcgctcttctccacgttgtcgttgcgttcctcgcgttctttcagttgctgagaattcacatgaggaatgcgcagcttggttggactcgtcaaaaagtgttccatgtattgattggctcttctaatttgggttacgtcatttatttggcattgacacttgttgctgcctgcaagggatggacctgttggtcgcattcttgtggttttgtatttatggctttccccaaagtacttttttttgcagcatttcttcttcttttatccttctgcaggtacttagtacttacagaccctctttattag

SEQ ID NO: 3714 - DNA, 990 bp, Glycine Max; identical to SEQ ID NO: 525

SEQ ID NO: 3715 - DNA, 1323 bp, Glycine Max
atgtcggtgacagcgggtgttagtgatactgtaatagccattagggataagctcagaggtaaaattggccaaactaaagttaagcgttattggcccggtaaagttcctgaatgggctgatgatgagaacgaagaagatgctgcccctgccgatattagaccctccagggaagctgccttggagaaagcctttcctcgtcacgaagaagacgctgctattgtcagaaaagacgatcgtaggctccgccgtttggccgagagccggatagataaccgtgaggaggtccgggctgatcatcgccgcattcgccaggctgagattgtttccaccattgaagaggaggccaggaggcaggaatggttggagttcgaagaagaagatgagaatgctttggcagaaagaaggaggctgattaaagagaagttgcttcagagagagcaggaagaggcacttcctcaggaagaggaagaggaggaagaagaagaggaggaggaggaggaatctgagtatgagactgactctgatgaggaatatacgggagtggctatggtgaagcctgtgtttgttcccaagtctgagagagataccattgcggagcgtgagcgtcttgaggctgaggagctggcttttgaggagaaaaggaaaaggagattggaggaaaggaggattgagacgaagcagattgttgttgaggagatccggaaggatgaagaaatccagaaaaacttggaaatggaggccaacattgctgatgtcgatacagatgatgaagttaatgaggcagatgaatatgaagcttggaaagtgagagagattggtaggatcaagagggatagggaggatcgggaggcaatgttgaaggaaaaggaagagattgagaaggtgagaaacatgacagaggaagagaggagggagtgggaaaggaggaatcccaaacctgctccaccaccaaagcagaaatggagatttatgcagaaatactatcacaaaggtgctttcttccagaatgaatctgatgaccgagctgccaccgttggatctgatggtattttcgctcgtgatttctctgccccaactggggaggataaaatggacaagacaatattgccaaaggttatgcaagttaagcactttggtcgtagtggaagaaccaagtggacccatcttgtcaatgaggatactactgattggaataacccgtggacttacaatgacccacttcgtgcaaagtataatgacaaaatggcagcaatgaatgcacctatagtaaaacctaaaggaagcaagaagttgaaagattgggaatctagggaatctggatga

SEQ ID NO: 3716 - DNA, 1071 bp, Glycine Max
atgtcgtcgtttctgcaccagagaagcagtctccagaacccattctcgaatccattcccggcatcaactccatcatcatcgaattcgaagaaatccctgtccatcatgggccccaccaccctcctagccctaatctccctcatagtcatactcggcgtcttctgcccctgggtgggctttccccagggcttccccttcactcccactcccacttccaaatgggctcactacactttagaacaagcgctctccttcgtcgccaaaaacggttcctccgtcatcgtctgcattgtgagccaaccctacttgcccttcctcaacaactggctcatcagcatttccatgcagaagcgccaagacatggtccttgtcatcgccgaggactacgcttctctcgacagggtcaatctgctttggcctggccacgccgtcctcatccctcccgtcctcgacgccgaagctgcccacaagtttggttctcagggtttcttcaactttacagcaaggcggccaagccatctgctgaagattttggagcttggatatagtgtgatgtacaatgatgttgatatggtttggttggcagatccatttccttatctgcaagggaaccatgatgtgtactttacagatgatatgactgcaattaaaccattgaaccattctcatgatttaccaccaccaggaaaaaagggccgtccttacatttgtagttgcatgattttcctccgccctaccaatggagcaaagctaattttgagaaagtggattgaggaacttcagattcaaccctggtctaaaactgtgaaatctaatgatcagcctgcttttaactgggctttaatgaagaatgctaaagaggtggatttgtacctgcttccacaggcagcattccctacaggcggattatatttcaagaacaaggcatgggttaaggaaactaaaggaatgcatgttatcattcataataactatatcgttggctttgagaagaaaataaagcggttccgtgactatggtctctggttggtggatgatcatgcacatgagtcccctctaggaggattatga

SEQ ID NO: 3717 - DNA, 297 bp, Glycine Max; identical to SEQ ID NO: 526

SEQ ID NO: 3718 - DNA, 1092 bp, Glycine Max
atgtctaagaggtttctttgcaagttctttgctcatggagcttgtctgaaaggggagcattgtgaattttctcatgactggaaagatcctccaaataatgtatgcacattttatcagaaaggagtctgtgcttatggtagtcgctgcagatatgatcatgtcaaagcttctcgagagcaatcttctgctccatcttcttcagtaatcgaaccccagaccctggtttcagatactgttgcttttggaaatactagagctgcatcaaatggtgttgctacaggggcagagttttctctttccagtagtccttaccttcttcctagtgaaccggcttggaatcgagaactggtttggaatcaagaatttgggtatcatgaacctttatgggaagacaatgttggtcaatcaataatcacttcaccttctgagctttcaatttgttcatttgctggagctggaaactgtccacgaggcgaaaaatgccctcatattcatggggatctatgtcccacctgtggaaaacattgcttgcatcctttccgacctgaggaaagagaagaacatatgaagacttgcgaaaataagcgtaagcatcttgaggcattgaaacaaagtcaagaaattgaatgcagtgtttgcctggagcatgttctgtcaaagcctacagcagctgaatgtaagtttgggctgctatcagaatgtgatcatccattctgcatatcctgtattaggaattggcgtagtagtaacccaacattggggatggatgttaatagcacattgagggcatgtcctatttgtcgtaagctgtcgtactttgtcattccaagtgtcatttggtactcaacaactgaagaaaaacaagaaatcattaacaactacaaggcaaagctcaagtcaattgattgcaagcactttgactttggggaaggaaactgcccttttggaactagttgtttctacaagcatgcatttcaagatggccgtctggagcaggtagttttgcgacatctaggggctgcagagggtgatactgtaattgcaaaagacatcaggttgtcagatttcctttctaacatgcatttaagatga

SEQ ID NO: 3719 - DNA, 684 bp, Glycine Max; identical to SEQ ID NO: 527

SEQ ID NO: 3720 - DNA, 1542 bp, Glycine Max; identical to SEQ ID NO: 528

SEQ ID NO: 3721 - DNA, 1413 bp, Glycine Max; identical to SEQ ID NO: 529

SEQ ID NO: 3722 - DNA, 504 bp, Glycine Max
atgtctactcaaattcaaaatggttcttcctcctcatcacaacaaccactgagtcgctatgagtcacaaaagcggcgagactggaacacctttggacagtacctgaggaatcagagtcccccagttccactctctcagtgcaacttcaaccatgtgttggatttccttcggtacctcgatcaatttgggaaaaccaaggtccacttgcacggttgcatcttctttggccagcccacccctcctgcaccctgtgcctgccctctcaggcaagcatggggtagcctcgatgccctcataggccggcttcgcgctgcctatgaggagcatggcggatcgccagagactaatccctttggaggaggagccattcgggtgtacctgcgtgaggtcaaggagtgtcaggcaaaggctagagggatcccatataagaagaagaagaagaagagaaacccaattctcaaggggactcaaagagctaaagatatcgagcaacaagcttcttga

SEQ ID NO: 3723 - DNA, 1566 bp, Glycine Max; identical to SEQ ID NO: 530

SEQ ID NO: 3724 - DNA, 1377 bp, Glycine Max
atgtctataacgcacagcctcactactccactctcttcttcttcctctgctttcttagctccttcttccttcaattgcaggggacaggtttcgttgcctgtgaagagcgtgagcatttgcaaatgcgttgccacacccgaagctgagactgcctacaagacaggggtcaatcgcaatccaaatatggggaaacttcaagctggctatctctttcccgagattgctagaagaaggtctgcgcacttgctgaagtaccctgatgctaaagtaataagccttggaattggtgatacaactgaacctattcctgaagtcataactgatgcaatgtcaaagagatcacatgcattgtcgactatagaaggatacagtgggtatggagctgaacaaggtgaaaagccattaagaagggcacttgcttcaacattttacagcgatcttggcatagaagaggatgatatatttgtctcagatggagcaaagtgtgatatatctcgtctccagattgtctttgggtcaaatgtaaaaatggctgtgcaagacccttcatatccggcctatgtagactctagtgtaattatgggccagactggcctcttccagaagaatgttgagaagtttgcaaacattgaatacatgaggtgtaatccggaaaatggtttcttccctgatttgtcttcaatttctcgaccagatataatatttttctgttctccaaacaatcctactggtgctgtggcaacaagggaacaactgacccaactagttcagtttgctaaggacaatggttctatagtaatccacgattcagcttatgcaatgtatatttctggtgacaaccctcgctcaatatttgaaattcctggagccaaagaggttgccattgagacttcatcatttagcaagtatgctgggttcactggagtccgattgggttggactgtggttccgaagcagttgctgttttctgatggatttcctgttgccaaggacttcaaccgtattgtatgcacttgtttcaatggtgcttcaaatatttcccaggcaggcggtctggcttgcctttcaccagaaggtcttaaggctatgcgtgatgttattggattctacaaggaaaatactaacataataatggagacatttgattctcttgggtttaaagtctatggagggaaagatgcaccatatgtgtgggtccattttcccggccgaagctcatgggatgtattcgctgagattcttgagaagactcatgtggttacaacccctggtagtggttttggacctggtggtgaaggttttatcagggttagtgcctttggtcacagggaaaatgtcttggaggcatgcagaaggttcaagcagctatacaagtga

SEQ ID NO: 3725 - DNA, 3297 bp, Glycine Max
atgtctatggcggacacaaatacaaactcagttgacgtgattttggactttcttaggaggaaccgattcaccagagctgaggctgctttgctcagtgagatcagtaatcgtccggacttgaatgccttccttcagaagcctcaaggtcaaggtcaagaactcattgtcaaggaaattgagtgtggaaccaaatggaaaacaacttcggaggatttatactcctggaagttcaaccccaccaatggtcctgtcaaggccactgtatccaaatgtcaaactgttgatgtaattgcagccaataccaattcaaagtctgggtcaggggaggaaaatgctgacaaaaaatccacgtggcctgcaagtagtagtaaagcctctgttgtgcaaagcaaagaacctagggaacttgatcgccaacttaaattcaatagttcatctcttgaagtgaacttcacagataatccctgcccaagaaaggatgagaatgtgaattcgtcttcagactccagcaaagattgttctgtcaagactgtcttccccttctcaaaaggggacgtgtctacaagctttgatggtgccacttattcttacaaaatagaggagaaaaaaaaggtagaaattagtgatactaggacatctattgaagagcaggtgggtgaattggggaggcctatttacttggtcaagacaccaggcagttctgaacagaagatgataggaagcttaagttttcctctcccccctgaaaatctgaaggaagagattcctaggcttcctccggttaaactcaagtcagatgacaagcccttggttgttaattgggaggagaagtttgagcgagatggaccaacctcaaaactccctggtgctgatagcactttgcttgttggttcatatctggatgtacctattggacaggaaattaacccttcaggtatgaggaaggctacagggggctgttggttatctgtaagtcaagggatagcggaggatacatctgatcttgtatcaggatttgctacagttggtgatgagttgagtgaatctattgattatccgaatgaatattgggactccgatgaatatgatgatgatgaggatgttgggtacatgagacaacctattgaggatgaggcctggtttttggcgcatgaaattgattaccctagtgacaatgaaaaggggactggacatggaagtgttccagatcctcaggaaagaggtccagccaaagatgaggatgacgatcaatcctttgctgaggaggattcttacttttccggggagcgatatcttcaggaaaataatgttgaacctgtcacagctactgatgatcctattggtctaacacacactgagtatggaaggactaatgataatgatttaatggctcaatatgatggacaattgatggatgaagaagaattgaacctaatgtgtgcagaaccggtctggcggggctttgtccctcagacaaatgaactcatcatgctaggagatgggagggttttgaatgataatgtaagatcacggctagaggacatcagtatggatgatgatcaacatggttcagttaggtcaattggggtagggatcaacagtgatgctgcagatattggtagtgaagtgcgtgaaagtttggttggtggtagtagtgaaggagatttagaatatttccgtgatcgtgatgcaggacttggtggttctaggcactctcatcatgattttgataagaaatctactaacaaatcaaacaaaaataagaactacgaaaagagtgaatcaaataaatatgtcataggatgtgataaagatgcaccgttgcagatgaaaactcatggtgatggaaacttctcatttcccctatctttgaaggatggccagatgattcaggcttccaccaataagtccctgtggtcaaataacggcaacacagatgaagctgatgactgtcttcatgcatttgtgggaactgatgacatgcttgctttgtggaggcgaaagagcagtgattcttcacctgttaaaagttatgagaataatgccgacattgtaagatccacaaactcttctccaacaacagtctcaaattatgggtattctgaaagagagcatgtgaaagtagaagaagatgaaaagactggaattgcaagggaagatgatcttggagcatcgctagaggatgaagaggtagctgctgtgcaagagcaagtaaggcagataaaggcacaggaggaggaatttgaaaccttcaatctaaagattgtgcacagaaaaaacaggcatgtttttaatgtaactggctttgaggaggacaagaatttccatgttgttttaaattctgtaatagctgggaggtatcatgttactgagtatttgggatctgctgcatttagcaaagctatacaagctcatgacctacatacaggcatggatgtttgtgttaaaattataaagaacaacaaggacttttttgaccaaagtcttgacgagatcaagcttctcaagtatgtcaataagcatgatcctgcagacaagtatcacattcttcgattatacgattatttctattatcgagagcatttgttaatagtatgtgagctacttaaagcaaacttgtatgagtttcataaatttaatagagaatcaggtggtgaagtgtactttacaatgccaagattgcagtcaattaccattcagtgtttggaagctcttcagtttttgcatagccttggactaatacactgcgacttgaaaccagagaatattttggttaaaagctatagtaggtgtgaggtgaaggtcattgatcttggaagtagttgttttgaaacagatcacctttgctcttatgttcagtcaaggtcctatcgtgctcctgaggttattttgggacttccatacgacaagaagattgatatctggtctcttggctgcatcttggcagaactttgtactggcaatgtcctcttccaaaatgattcacctgcaacattacttgctcgggtgattgggatcattggtccaattgatcaaaatatgcttgcaaaaggacgggacacatataagtacttcaccaaaaatcacatgctttatgaaaggaatcaggaaaccaaccggttagaatacttgattccgaaaaagacatccctgaggcatagattgccaatgggagaccaaggcttcattgactttgttgctcacttgcttgaagtcaaccctaagaagcggccctctgcatctgaggccctgaagcatccatggttgtcatacccatatgaaccaatatcatcttga

SEQ ID NO: 3726 - DNA, 804 bp, Glycine Max
atgtctcacttcggacgttcgggtcccccagacatttccgacacttactctcttctcgttctcaacatcaccttccgtaccaccgccgacgacctattccctctcttcgacaagtacgggaaggtcgtcgacatcttcatccccaaggatcgaagaactggtgagtcaaggggttttgcattcgtgcgttacaagtatgctgatgaggctcagaaggccgttgagaggctcgacgggagaatggttgatggtcgtgaaataaccgtccagtttgcgaaatatgggcctaatgctgagaggattcacaaaggaaggattattgaaacatccccgagatcaaggcgatcaaggagccgtagcccaaggaaaaggcatcgtgatgattacaaagatcgagattataggaggcgaagtcgcagcagaagttatgataggtatgaacgtgacaggcaccgtgggagagacaaagattatcgtcgcagaagcaggagccgtagtgccagtcttgattacaagggtcgtggtaggggacgctatgatgatgagcgtaatagtagaagccggagcagatcagttgatagcggctcccctgcacggcgcagtcctagtcctcgaaggagtccttcccctcagaggagcacttcccctcaaaggagtccttcccctaggaagagtccacggggtgaaagtcctgcaaatcgtagccgcgatgggcgttctcctacccctcgcagtgtctcaccacgcggtcgccctgatgcttctcgaagcccttcccctcgaaattcaaatggggatgaataa

SEQ ID NO: 3727 - DNA, 1248 bp, Glycine Max
atgtctccaagagagaacatatcacaaaaatggcgtgaaattcaagggtatcacaattgggaggacattttagaccctcttcagccgtggttacgtagagaaattgtcaagtatggagaatttgcacaagcaacctacgatgcctttgactatgattctttctcggaatattgtggaagttgtcgttacaaccaaaacaagttatttgagaaattgggtctcactagaaacagttacaccgtgactaggtacatatatgccatgtcacacatagagctaccacgttggctcgagaggtcacatgttgctgacacgtggagcaaagactctaattggatcggttttgtggcggttagtgacgatgacgagacacgtaggattgggaggagggacattgtggtggcgtggcgtggcaccgtggcaccgtgtgagtggtacgaggattttcaaaggaagttggacccaattgggcatggggatgccaaagttgaacatggatttcttagcatttataaatccaagagtgagactacaaggtacaacaaatcaagtgcctcagatcaagtcatgaaggaagtgacaaaattggtgaatttttataagggaaaaaaaggtgaggaagttagccttacaatcacagggcatagcctaggaggtgctttggcattgattaatgcttacgaggtagcaactacttttcttgaccttccagtaagtgtgatttcttttggggcaccaagagttggaaacattgccttcaaagatgaattgcatcaaatgggggtgaaattgttgcgtgtggtggtgaaacaagattgggtaccaaaaatgcctgggcttttgttcaatgagaagctaaaaatgtttgatgagattacggggttggaatgggtttacacacacgttggggctgaattggcgcttgatgttcattcatctccttatcttaaaggtggaatgaacttgtcagggtttcatagcttggagacttaccttcatcttattgatgggtacttgagtcatgagacaccgtttaggtcagaagctaggagggatattgcactagttaacaagtcatgtgatatgttagttgatgagcttagaatcccacattgttggtaccaattggccaacaaaggattggtttgtaatgctcatggaagatgggttaagcccaaaagagacaatgatgatattccttcacatgctagcgaagtattcaatgctggtcttggagttgtaatgtga

SEQ ID NO: 3728 - DNA, 1686 bp, Glycine Max
atgtctccttttgagcatggagaggttttcgtcttggatgatggtggtgaggttgaccttgatcttggaaactatgagcgtttcttggatatcaaattaactcgtgacaataatattacgactggaaaaatatatcagtctgttattgagaaggagagaagaggagattatcttggaaagactgtacaggttgttccacacataacagatgctatccaagagtggatagaacgtgtagcaaagataccagttgatgggaaagaagggccagctgatgtttgtgtcattgaattgggtggaactataggggatattgagtccatgccttttattgaagcacttggccaattttcataccgtgtaggccctggcaacttctgtttggttcatgtcagcctggttcctattctccatgttgttggtgaaccgaaaacaaagccaactcagcacagtgttcgtcaacttagaggattaggtttgacccctaatcttcttgcttgtcgcagttctaaggaacttgatgacaatgtcaaggcaaagcttggtcaattttgtcatgtgccgctgtcaaacatacttactctccatgacgttccaaatatttggcacattcctttgctattgaaagaccagaaggcacatgaggcgatcctgaaagcattaaacttgctaggtgttgctgcagagcctaatttgaaggagtggactgcaagaacaaaagtttatgacagatgtcatgaaattgttagaattgcaatggtgggaaaatacactggcctttcagatgcatatctttctgttctgaaggcacttttacatgcttctgttgctcgaaaccgtaaacttattgtggactgggttccagctggggatcttgaagaagctacttataatgaggatcctgaggcgcataaagctgcttggagtcttttaaagggtgctaatggggttctagttccaggaggttttggtgatagaggagtgcaagggaaaattcttgctgctaagtatgctcgagaacataatgttccatttcttggcatttgcctggggatgcaaattgctgttattgagtttgcacgatctgttctcggtctgcatgatgctactagcacagaattcaatcctgaaaccaagaccccttgtgtcatatttatgccagaaggctccaagactcatatgggaggaactatgcgtcttggttcaagaagaacttactttgaagttgctgactgcaaatctgcaaaattgtatggcaatgctagctttgttgatgagcgacatcggcatagatatgaggttaatcctgacatgatatcacagctagagaatgctggtctatctttcgttgggaaagatgaaactgggaggcgcatggaaatagttgaattgcctagccatcctttttttattggcgttcagtttcaccctgagttcaagtctagaccagggaaaccttctccactcttctcaggattaatagcagcagcaagtgaacaaaggagtacaatcatggtgccaagtagtaatggtcatgccaagttaactaacggaaatggaatgtacaatggacactcgccgaaacttaaagcacaccaaaagggaaatggcttcaaggcatccaatggttccttaaatggtatatataccaatggaaatggggtgtatgtggatggtagttgttag

SEQ ID NO: 3729 - DNA, 588 bp, Glycine Max
atgtctcgaaacgacgacgtagtggaacagaacgcggccaccaccaccaccacgtcgtcgaccactataagaaacagagcagacccgttcctggtagcgtgcagatgcttcagcttcctcacctctctcgccgccattctctgcatcgccgtcaatgtcctctccgccgtccgttccttcaaacacgcatctgacattttcgacggcatattccggtgctacgccgttcttatagcggctttcgtggtcctcgccgagaccgaatggagtttcatcataaagttctcgaaggttttggagtattgggctgccaggggtatgctgcagatctttgctgcagtcatgacaagggcatttcctggctatattggggaccggagggacctttttcttctacagagcatagcaagttatttgctacttgcctgtggtgttgtttatgttgtttcaggtatcctttgcattggttttcttaaacgtgcccgccagaagcaagagattacaagagagcaagccaccaaggatctagaggagttggaacgccgcagagaggaacttgaacaactactccttgctgagagagtttaa

SEQ ID NO: 3730 - DNA, 588 bp, Glycine Max; identical to SEQ ID NO: 3729

SEQ ID NO: 3731 - DNA, 975 bp, Glycine Max; identical to SEQ ID NO: 531

SEQ ID NO: 3732 - DNA, 462 bp, Glycine Max
atgtctctgattccaagtttcttcggtggccgaaggagcagtgttttcgaccctttctccctcgatgtgtgggaccccttcaaggattttccatttcccagttctctttctgctgaaaattcagcgtttgtgagcacacgagtggattggaaggagacaccagaagcacacgtgttcaaggctgatattccagggctgaagaaggaggaagtgaagctggagattcaagatggcagagttcttcagataagcggagagaggaatgttgaaaaagaagacaagaatgatacgtggcatcgcgtggagcgaagcagtggcaagttggtgaggaggtttagattgccggagaatgctaaagtggaccaagtgaaggcttccatggaaaatggggttctcactgtaactgttcctaaggaagagattaagaagcctgatgttaaggccatagacatctctggttaa

SEQ ID NO: 3733 - DNA, 462 bp, Glycine Max
atgtctctgattccaagtttcttcggtggccgaaggagcagtgttttcgaccctttctccctcgatgtgtgggagccctttaaggattttccatttcccagttctctttctgctgaaaattcagcctttgtgagcacacgagtggattggaaggagacaccagaagcacacgtgttcaaggctgatattccagggctgaagaaggaggaagtgaagctggagattcaagatgacagagttcttcagataagcggagagaggaatgttgaaaaagaagacaagaatgatacgtggcatcgcgtggagcgaagcagtggtaagttcatgaggaggtttagattgccggagaatgctaaagtggatcaagttaaggcttccatggaaaatggggttctcactgtaactgttcctaaggaagagattaagaagcctgatgttaaggccattgacatctctggttaa

SEQ ID NO: 3734 - DNA, 243 bp, Glycine Max
atgtctgaaagagaagagtgtgagcgcgttttcaagcgctttgatgtgaatggcgatggcaacatctccttgtccgagtttgcagatgctctcaaagtgctaggcttaacttcacaggaggaagttgagcgtcgaatgaaagagatagataaagatggtgatggatacattacactcgaagagttgattgaatttcatactgccaaccctagtttgatgagggatgtcttgaagaaactctaa

SEQ ID NO: 3735 - DNA, 219 bp, Glycine Max; identical to SEQ ID NO: 532

SEQ ID NO: 3736 - DNA, 588 bp, Glycine Max
atgtctgacgtggaagagtatcgttgtttcattggtggccttgcgtggtcaacatctgatagaaagttaaaggatacgtttgaaaagtttggcaagcttattgaggcaaaggtggttgttgacaagttctctgggcgttctcgtggttttggatttgtcacatttgatgacaagaaagcaatggacgaggctattgatgctatgaatgggatggatttagacgggcgaactattactgttgatagagctcagcctcaacaaggatcaactagaggtgatggtgatcgctaccgggatcgtggtcgtgatcgtgaccgagatcatggaggtggaggtggccgaggatctaatggtggtgaatgctttaatgccctagtgaagggtccaggggaggaaagtatggtggtagggaaagtagatatggtggaagcagtggtggtggttatggaccagatagagcagatcgttcttcaggggggcgcagcaggggatggtggtagtcatggagattctggaagtgatcgattttatcgtgatcgttcaggaccatatgagcgagagcgacggggatcaggaggctttcgttga

SEQ ID NO: 3737 - DNA, 1440 bp, Glycine Max
atgtctgatcattgtttgaagagcagcaaagtagattctagtagtagtgagctttgtgctgatgataccatcttaggagacaagtgtgtggtggaggatgacagtgtgtctcaatattcaatcaatcacatatctcaaaccgacaatgaactcagctttcttgataatgatgggtggctcgatatcggaaactttgaagatgttgataggatgatgttaagctgtgacttgacatttggaatggggagcctcaataatgaagaggagttctgctggctccggtcttcgcaaggaactgaaggatctgatgatgcattgaagtctgcgttcaagttttcatctgctgaagcaagtccgttgaaaagtatatctgattataatatagacacaaatgaaaacatggaaggtctgccaattaatgacgggaacatgcaaggaaacctgtcaaaaacatccgcaggaaagagaaaaactggctacttagaacatgctgattctgatcttccttatgctcaagtggagcaatatatacaaactgacctgatggacccagactattgtcatacttctaattacacttccctctttgcaaccttgtctggatctaggtctgaacatgatggacatccatctccttcttttaaagaatctgaaaatatggaaaatcccgtgccattcaaaagtccaggttcagctcagaaggtaggccatcagtttgaaaatgagaatgaaggccatagtgaagtcggagaaattagcataagattttcacaagaaatagactcatcaaatgtgcaggaaagctcatctatgagctctgcactggacgaagcctcacttgaagcaactagctttcgccaactgcaacaggtcatggatcagttggatattagaactaaactatgcataagggacagtctataccgcttggctaaaagtgctgagcaaagacataatgataccaatgcaagtgctaaattatatcaaacagaaacttacattgagcataagaatttctcaacccaagtttatatcaattacagacattttggcacacagctgaaatattcttgtagtctcgactcaaatgtcttacctattgcactaagaaaaaggaacagagccttgcatcttatttcctactcctatccagtattaatatctgtagaaatacgatttttatctattaatcttttttataacatcttcaggtgtacgggattcatgaatattgaaactgatacgaatcccatcgatcgaactatagcacacttactgtttcacaggccttcagatccatcaatgttgccccataatgatcctttacctttcaaatccagttccatgttacatggatcggtgatcaatccagcagtagaagtgactgagaaacaggtttttcaggaagaatcttctactggattagaaaagtcgtcttaa

SEQ ID NO: 3738 - DNA, 594 bp, Glycine Max
atgtctgcagcggcgcgtttgggtagaagagtaggcacaacagcaaaggaagaactgagaagaaacaaaggagcatggcgcgatcctcttccggccgccgcttctcgcgcaatcgcggagagaatcccgttggcggatctcgttgtccaagtcagagacgcaaggattcctttgtcctctgaatgtgagatactcagaaactaccctccttccctgaaacaaatcgtagcgctcaacaaaatggacctcgtgggcacatcgaatgtgaaggtgtgggggcttcttctcgctttattcttttttcttttaccatttttaagctttctggaattttcatatacatgtgaaagacatcaaaggtcggtcctgttgataaggaatgaagtcatatctcgaaagtcacttaaaacttttttattcaccaaaaaaaaaaatacaagtgaaagattgagtgtttttgtccttgatttttttactattttcgaaactggggttcctgaaagtagtttatgggggcttcaaatgataatatatatattgaataagtaccagaggtaccaaaagttacaaattacagttttgtgccacagataa

SEQ ID NO: 3739 - DNA, 1608 bp, Glycine Max
atgtctgcgattgcgatcttaccctttctactccacgttctaatggctgcttcagaatcagaaccttttcaagacagtattctccagtgcctctctctctattctgacccctctcttccaaatccaatctctgctgtcacctatttccccaacagcccctcataccctcccatcttagactcctacatcagaaacctcagattcagttcctccacaactccaaaaccatccttcatagtggcaccaacccacgtgtcccacatccaggcctccatcatctgctgcaaaagcttcaaccttgagatcagaatcagaagtgggggccacgactacgatggcctctcctacgtttcagaagccccatttgttattcttgacatgtttatgctcagatcagtcaaagtcaacttggatgatgatgatgacactgcgtgggttgactcggggtcaacgattggtgaactctatcatgcgatcgctgagaggagcaagatccatgctttcccagctggggtgtgtcacagtgttggtgttggaggacatttcagtggaggaggctatgggaacatgatgagaatgtttggtctctctgtggatcatgttttggatgcaataattgtggatgctcaaggtagagtcttggataggaagttaatgggggaagatcttttctgggctattagaggaggtgggggagctagctttggagtcgttgtgtcgtggaaaattaggttagttcctgttcctgaggttgtaactgttttcagagttgaaagaacattggaacaaggtgccactgatgttgttcataagtggcagtatgttgctgataagttacatgatggcttgtttattagagtggttcttagttctgtcaaaagaaagggtgtgaagacaataagagccaagttcaatgccttgttccttggaaattcacaagagttgcttggtgtgatgaataagagcttccctgaacttggtttggttgctgaacagtgcattgaaatgagttggatcgattcggtgttgttttgggacaactatccagtggggacttcggttgatgttttgcttcaaaggcataatacacaggagaaatacttgaagaagaaatcagattatgtgcagcaaccaatttccaaaactggccttgaaggtatatggaacaagatgatggagctagaaaaacctgctcttgcattgaatccctatggtgggaaaatgggtgagatttctgaggtggaaacaccgtttccacatagagctggtaacatttataaaattcaatactctgtgacttggaaagaggagggtgaagatgttgctaacagatatctagatcggattcggaggctctatgattatatgacaccttatgtgtcaagttcacctagaagttcatatatcaactatagagacgttgatataggtgtcaatggacctggaaatgctagttatgcagaggctagagtctggggtgagaagtatttcaaaagaaactatgatagactggtagaggtaaagaccaaggttgatccaagcaattttttcagatatgaacaaagtattccatcacttgcatctggtctaagcataatgtcagaatag

SEQ ID NO: 3740 - DNA, 717 bp, Glycine Max
atgtctgctgctgtgtctgcaaccaaggatgttcccttcaatgctcatttggaggaagatatcaaaaacaaagaaatcaacaaggttgttaatgttggggaagcagaccagattccttacaatgatgatgctgaaggaactgattcagaggcagaggaagaccccaagttggaattggatcttggccctcagtgttccctcaaggaacagcttgagaaagataaagaggatgaaagtttgagaaaatggaaggagcaacttctgggaggtattgatgtgtctgctgttggagaaaacaaagagcccgaagtgaagatagtgagccttaccattatatgtccagggaggcctgacctcattctgccaattccatttacttctgatgctaagaagagtatcttcacccttaaggaaggaagtcaataccagttgaaattctctttcactgtctccaacaacattgtttctggcctcaaatacaccaatgttgtttggaaaactgggcttagagtggacaacacaaaaaaaatgttgggaacttatagcccaagccaggaactatatacatatgaattggaagaagaaactaccccttcagggttgtttgctaggggaacctattcagcaagaaccaagtttgtagatgatgatcggaaatgctacttggatactagttaccactttgaaattcagaagaattggcctacacccatctaa

SEQ ID NO: 3741 - DNA, 1380 bp, Glycine Max
atgtctgtgtctacccctcaaacaaagactagtagtacgaataatcttcaaggtcaaggaagtggtgctagttctcgcagtgacagcttagagagcacaagtgcacccattaggccacacactggtggtgatgtgaggtgggaagctattaacatgatttcaagggttggccctctcaatctcagccatttcaggcttctcaagcgaatcggttatggagacattggaagtgtgtaccttgtggaacttaagggaacaaggacctactttgctatgaaagttatggacaaggcagctcttataagcagaaataagcttctgagggcacagacagaaagggagattcttggactccttgatcaccccttcctcccaactttgtattcttattttgaaactcgtaagttctattgtttggtcatggaattctgtagtgggggtgatcttcattctcttagacagaagcaacctaataagtgtttcactgaagaagctgcaagattttatgcttcagaggttttgttagctctggaatacttgcacatgcttggcattgtatacagagacttaaagccagagaatcttctagtcagagacgaagggcacatcatgctctcagattttgatttatcccttcgctgctccgtcaaccctacactagtcaagtcttcttctgcccatgcaagcaacagtagtagtggcagcaacaacgatgttggcagcatattaaccgatgaccaagcagtgcaaagcactactcaggtatcaagttttttcccacgcattttgccttcgaagaagaaccgcaaggcaaagtcagattttggcatactggttggcggaggacgccttcctgagctgatggcagaacccaccaatgtgcgttcgatgtcatttgtagggacacatgagtaccttgctcctgagattatcaaaggagagggtcatggtagtgcagtagactggtggacttttgggatcttcttgtatgagttgttgcatggaacaacccctttcaagggttcaggatataaagccacacttttcaatgttgttggacaaccacttagattcccagaaactccccaagtcagtgccgtggctcgtgaccttattagagggttgttggtgaaagagcctcagaagagaattgcatacaagagaggagctacagagataaaacaacatccattttttgagggcatgaactgggctctggttagaagtgccacccctccccacataccagaggttatagatttctcaaagtatgctagcaaagacacagcacccccaccagacaagaagatggcagatattgctaatgataaacacagcaacagtgctactgattcttacatagaatttgagtatttttag

SEQ ID NO: 3742 - DNA, 942 bp, Glycine Max
atgtctgttgaacctaaggaactttactaccaggaccttgtcctagaccacaatatcattaataatcagcatcagggcacagaagcaggatctaatactactatgtacgaaaagcacttttcctctaccttaattccttcagtttcagcagcatatgattcatcacaagcctttgatccctcttacatgagtttcactgactgtttgcaaggaagcatggactacaactcacttgcaacttcttttggcctttctccttcctcatctgaggttttttcttctgttgaagggaaccaaaagccagcagaaggaggaggagatggtggtggtggtggtggtggtagtggtggcagtgaaacccttgcgacccttaactcttctatctcttcttcatcttctgaagccggggctgaggaagattcaggaaagagcaaaaaagaaaggcaagtgaaaactgaagaaggaggagaaaactctaagaaagggaacaaggagaagaagaaaggagagaagaagcaaaaggagccaaggtttgccttcatgaccaagagtgaggttgatcaccttgaagatggatacagatggagaaaatatggacaaaaagctgtcaagaatagcccttacccaaggagctactacaggtgcactacacagaagtgcacagtgaagaaacgcgtggagaggtcatttcaggacccaaccactgtgataacaacgtatgaaggtcaacacaaccatccggtccccacttctctcagagggaatgcggccgcaggaatgttcacaccctcttctttgctagccacaccaactcatccactcgcagccgggtcaaacttcccgcaagatctcttccttcacatgcattaccctcaatacggcctccttcaagacatagtcccttccatgttacacaacaagtcccatcataaccagaattaa

SEQ ID NO: 3743 - DNA, 3812 bp, Glycine Max
atgtcttatagaagggggtctgatctgcctccgcaaaggcggatactgcggactcagactgctgggaatttaggagctgacccgatcttggacagtgaagtggtgccttcctcacttgttgagatagctcccatcctccgtgtcgctaatgaagtagaagctagcaataaaagagttgcttatctctgtcggttttatgcctttgaactagctcacagactagatccccaatcaagtgggcgtggtgttcgccaattcaaaactgctcttcttcagcgcctggagaaggaaaatgtcacaacacacgagggaaggaaaaagagtgatgctcgtgaaatgcagactttttataggcagtactatgaaaagtatattcaagcgttagataaagctgctgataaggaccgtgcccagctcacaaaagcataccaaactgctgcagttttatttgaggtattgaaggcagttaatcgaacagaagatattccagtatctgaggagattatacaagctcatactaaggttgaggaacagaagcaattatatgtcccttataatattttgccacttgatccagagagtggaaaagaggctataatgagatatcatgagattcaagctgctgtttctgcactccgtaataccaggggtttgccttggccaaaggaacatggcaacaaagtaaatgaagacattctggattggcttcagctgatgtttggtttccagttggacgatcgtgctttaaatgaagtgatgaagaaactctttagaaactacaaaaaatggtgcaagtatttgggtcgcaaaagtagcctttggttgccaaccattcagcaggaaatgcaacagcgcaaattattatatatgggtctatatcttctcatatggggagaagctgcaaatttgagatttatgccagaatgcctttgttttatataccatcatatggcatttgagttgtatgggatgttagctgggaatgttagtccactgactggtgaacctgtaaagcctgcctatggtggtgataatgaggcttttcttatgaaagtagtaaaaccaatatatgatgtaatagccaaggaagctgagagaagtaatatgggaaaagcaaagcattctcactggagaaattatgatgatttaaatgaatatttttggtcagttgattgttttcggctaggttggcctatgcgtgttgactctgatttcttctctgttccttttcctcaacagcaacatcaagttaacaaacacgaggaaaacagaggtcctgcttcagaccggtggagtgggaaaactaattttgttgaaatacgcacattttggcatatatttagaagttttgatagaatgtggagcttttatatactctgtttacaggcgatgataatcattgcttggaatggttctggaaaattaagctcaatatttgatggtgatattttcaagcaagttctcagcatcttcataactgctgcaatattgaagcttgcacaagccattctggacgtattccttagttggaaagcaaggaaagtcatgtcgcttcatgtccagctgcggtatatatttaaggcaattttagctgcagcttgggtcataattttaccagttacttatgcttacacttggaaaaatccatctggctttgcacaaaccataaagaattggtttggcaatggtacaggttccccttctttgttcattttggctgtcttcatctacttatctccaaatatactctctgcactgttatttgtgttcccattcattcgccagtttcttgagaggtctaataatggtgttgtgaagctcatgatgtggtggtctcagcctcgactctttgttggaagaggaatgcaggagggtccaatttccttgttgaagtacacttgtttctgggttatgctaattctatctaaattagcattcagctactacctggaggtctactttatggatacacagatttggtatgccatcttctctacaatagtaggaggcatatatggtgcatttcgacgtttgggagagattcgaacattggaattactgaggtctcggtttgattcaattcccggtgcttttaatgcttgcttgattcccacagaacagactgagaagaaaaaaaagaggggattaaaggccactttttctcggagatttgatcagagccgattgtttcaggtcgcttctaataaagataaggaatctgcaaggtttgcacagttatggaacaaaataatcactagtctgagggaggaggacctgattgataatagggagatggatctcatgcttgtaccatattcggccgaccgttctttgaacctcatccagtggccacctttcttacttgctagcaagatcccaatagcagtgtccatggccgaagacagtttagggaaaggacaagaactggagaaaagattgtcaagagacaagtacatgaaatctgctgttgaggaatgctatgcttcttttaaaagtattattaacttcttggttcttggagagcgtgagacaatcattgttacattatggtttcacaaatgcagggttatacagaatatttttcaaagagttgatgtgcacatagaaaacaaagctgtgctgaatgaattgaatctgagtgctgtccccagtctatatgaacgatttgtcaaactgattgaacgtttgttggagaacaaagaggaggacaaggattcaattgtgattctcttgcttgacatgctagagattgtgaccagagacataatggatggagacattgagggtttgctagactcaagccatggtgggtcttatgggaaagatgaaaggttcacaccccttgaaaaacaatatacattttttggcaaacttcaatttcctgtcaaaacagatattgatgcttggacagagaaaataaaaaggcttcatttacttcttactgtcaaggagtcggctatggatgttccatccaacttggatgctaggaggcgtatttctttcttctctaattcattgtttatggatatgccacctgctcccaaagttcggaatatgatgtccttctctgaagtccgaggaatgatgtatatccgacaagcattggagctacaggcttttcttgatatggcaaaggatgaagaattaatgaaaggttacaaggctgcagaactagagagcaaggaaagtacaaccggtgagcggtcgttgtggactcaatgtcaatcattagctgacatgaagttcacttatgtagtttcatgtcaacaatatagtattcataagcgatctggtgatcccagggcaaaagaaattttaaagcttatgattaagtacccatctcttcgagttgcttacattgatgaggttgaagagcatagcaaaggctcatcccgaaaaacagataaggtttattattcagctctagtgaaagctgcattaccagcaaaatcaaatgattcatctgaagcagttcagagtttagaccaggtaatttacaagataaagcttccaggacctgcaatattgggtgaggggaagccagaaaatcaaaaccatgccataattttcacacgtggggaaggcttgcaaacaattgatatgaatcaggataattatatggaagaagctttcaaaatgaggaatttgctgcaagaatttctcaaacaacatgatggtccaagaatgccgacaatacttggactcagagagcatatatttactggcagtgtttcatcccttgcgtggtttatgtctaatcaggagcatagttttgtgacaattggacaaagattgttggcttaccccttgaa

SEQ ID NO: 3744 - DNA, 537 bp, Glycine Max
atgtcttctcgcttagatgagtgcttgttggaggtggatgggtacggtgatggcgatggaaaggcgaaacccaaattcctgataaggaatctcagcagagtttcggaggatggggttcccatcctcaaaggcataaatcttgagatcccagagggtgtgatcgtgggagtgataggccccagtggtagcggcaagtcaacgttcttgagggcccttaaccgcctctgggagccaccctccgcctccgtcttcctcgacgcccaagacatctgccatctcgatgtcctctctctccgccgtaacgttgccatgctctttcagctcccggccctctttgaaggcagcgttgcggacaatgtgaggtacggaccacaactcagagggaaaaagctaagcgatgatgaggtgcgcaagttgcttctaatggccgacctggatgcttctttcatggataagtccggggctgaactctctgtcggtcaagctcaaagagttgcacttgctaggactttagctaattcaccccaggtaacttaa

SEQ ID NO: 3745 - DNA, 783 bp, Glycine Max
atgtcttctcgcttagatgagtgcttgttggaggtggatgggtacggtgatggcgatggaaaggcgaaacccaaattcctgataaggaatctcagcagagtttcggaggatggggttcccatcctcaaaggcataaatcttgagatcccagagggtgtgatcgtgggagtgataggccccagtggtagcggcaagtcaacgttcttgagggcccttaaccgcctctgggagccaccctccgcctccgtcttcctcgacgcccaagacatctgccatctcgatgtcctctctctccgccgtaacgttgccatgctctttcagctcccggccctctttgaaggcagcgttgcggacaatgtgaggtacggaccacaactcagagggaaaaagctaagcgatgatgaggtgcgcaagttgcttctaatggccgacctggatgcttctttcatggataagtccggggctgaactctctgtcggtcaagctcaaagagttgcacttgctaggactttagctaattcaccccaggttttgttgctggatgagccaactagtgccttagatccaatatcgacagaaaacatagaggatgccctggtgaagctgaacaagaatcagggcatgacagtcatcatggtctctcatagcatcaagcaaatccaaaggatcgctcacatagtgtgcctgcttgttgatggtgaaattgttgaagttctcaaccctcataatctctctcaggccaaccatcccatggctaagaggtttcttcaactcagttcttaa

SEQ ID NO: 3746 - DNA, 621 bp, Glycine Max
atgtcttctcgcttagatgagtgcttgttggaggtggatgggtacggtgatggcgatggaaaggcgaaacccaaattcctgataaggaatctcagcagagtttcggaggatggggttcccatcctcaaaggcataaatcttgagatcccagagggtgtgatcgtgggagtgataggccccagtggtagcggcaagtcaacgttcttgagggcccttaaccgcctctgggagccaccctccgcctccgtcttcctcgacgcccaagacatctgccatctcgatgtcctctctctccgccgtaacgttgccatgctctttcagctcccggccctctttgaaggcagcgttgcggacaatgtgaggtacggaccacaactcagagggaaaaagctaagcgatgatgaggtgcgcaagttgcttctaatggccgacctggatgcttctttcatggataagtccggggctgaactctctgtcggtcaagctcaaagagttgcacttgctaggactttagctaattcaccccagtgccttagatccaatatcgacagaaaacatagaggatgccctggtgaagctgaacaagaatcagggcatgacagtcatcatggtctctcatag

SEQ ID NO: 3747 - DNA, 1161 bp, Glycine Max
atgtcttctctctggttccttaaactgtccctcaaatgccttgatcacctcgcatggcctcttcttgctttggggtatcctctatgtgcttccgtacaagcaattgagactgattccaataaagaaactagggatttgatctcgtattggatacttctctcgttaatatacctctttgagtatgcattttcgaggattcttcaatggttccagttttggccttacattaagcttatgatcatcttctgccttgtcacgccagactttggacgagcttcttatgcctataataaccttatccgcacttgcatctccttaaatccacaagcaatcatatgtaggttaaataactggaggaagttttttgtcaagaaagatgactttttactgcatgtagagagatatctaaacgagaatggaactgaagccttagagaaactcattgctagcaagaacaccaacctattgaagaacacaacttataaacctgatgcagaagcaacaaatgcaattatagcaactgataataatgaaacgcaacagacaaatgagacaaaactccaaacacagcaaaaaaccatcaaagatttggaggtgattgagaaaaaagaaattcttgcaggcaagcaagatatttctgttgtgcctaaccttgtgccaagtcagaatgcttcaccagccatggtggaaactaaaatattagtggggaaagacacagctagtggagagcttcccgagagttctacacataaggaagtgcagaaagagtggacatgcgctttatgtcatgtaacgacatctagcgagaaaaccttgattgaccaccttcatgggaggaaacacaaggcaacttgtgaatctctgaaagcacaaaatcaacctgtgccacataaggtgaaaagtgatcagtccaaagatgatttgaagcaaaagaacgttatctatcagataaattccaagaccaagagtggagagaaggtaggaaaagaagccatggaccataaggtgcagaaactgcaaaagaaactatatgaacctgctgggacgagtaattccaaatttctgtgtgaagtctgtaatgtctattgcccttgcgagattgctttggcctcacacaaaaatgggaagaagcatttggctaaaattaaaacttcaatctga

SEQ ID NO: 3748 - DNA, 690 bp, Glycine Max
atgtcttctcttcgaaacgccattcccaggcgtgctcacaaagagcgttctcaaccgtcgtcgaggaaaaaattcggccttctcgaaaagcacaaggactatatccagcgtgctaaagcattccacaagaaagaagacactttgcggaaacttagggaaaaagcagcgaatagaaatgaagatgaattttacttcaagatggttagaacaaaaaccgttgatggagttcataaaccagagagtgaagcgaataagtatactcaggaagagcttatgctgatgaagactcaggacatgggttacattcttcagaagattcagagtgagagaaataaaattgaaaggctaactgcctcactgcactctatcgataatcagccggcgaacaagcatgttttctttgctgaggacagggaagaggctaaagagttagaatcacgacatcaaaaaagtaaaattccacttacttctggtgatattcctgctggcattaagagaaaaacagatcggtcttaccaagagttggaagcaaggaggggtagactcagccaactagagaaaatctacatggatatgacaatgcagaaggagttgcagaaaaaaggtaggaagcgcaaactacgtgaagacgagattgtttgtccaacaactaaaccggtatacatgtggcgtgctgaaagaaagcgttga

SEQ ID NO: 3749 - DNA, 1221 bp, Glycine Max
atgtcttgtttgttaatgcaatccctcaagtcacaccctgctcttttattttccctttccaatcacttctctttctcttctcactctgtcagatcctttctctcttctttctccacatgccaacactcaaaggaaagcacttccattattgattatctaaatgccaagttcgatttctcgagaactcaatccttctacatctcaaaacgtgtttcaagcagcagattcccccaaaaccccttgtctgtgctcagttttttcaaacaatttgggttttctgaagcccagattctctttttgattcgtcacaaaccccagatactgttcactgatgttgacaaaatcttgagacccaaaattgagctctttcagctgttgggtctcgagcgctcggagttgtgcaagttcatttccaagaattcctccattttgactttcagtttgaagaaaacattggtcccctctgtggaagctattgggaaaattctctgcagtgagaaagattttgttcatgttttgctcagatgtggccggatactcccaaattacaaaaaatttatggacaatgttgtcttcttggaaagttgtggcattgttgggtctcatcttgcaatgctactcaaactacagccaggtattttcatcacacggcagtctattataggagactatgtttcgcgcgctgtagacatgggtttcaatgaaaattcaagaatgcttgtccatgcaatccattcaataagtagtttgagctataaaacatttaggagaaaactgaagctaattatttgttttggtttttccaatgaggagggcctgcaaatgttcagaagatccccaactttgcttagaacatcagagaagaaggtgaaggttggactggaattcttcttgcatacagttatgctgcccaaatcagtcctggttcatcagccaagggttttaatgtatagcatggaggatcgcgtgcttcctcgatatagagtcttccagctcttgatagaaaaaaaactttgcaagaaggtcccgagttacattcatttgttatgcttgtctgaggaggtgttcttggacaagtatataccacatttcagagaaaatgcagaggaattattaaagtgtatctgttttagcaacaaaaagtgtttactttacattggcattttgaaattgtccatttccacggaaacaacagtaaatatgtatgagaataactcataa

SEQ ID NO: 3750 - DNA, 462 bp, Glycine Max
atgtctttgattccaagtttctttggtggcagaaggagcaatgttttggatcctttctccctcgatgtgtgggacccttttaaggattttccttttcccacttctctttctgctgaaaattcagcgtttgtgagcacacgagtggattggaaggagacaccagaagcacacgtgttcaaggctgatattccagggctgaagaaggaggaagtgaagctggagattcaagatgacagaattcttcagataagtggagagaggaacgttgagaaggaagacaagaacgacacgtggcaccgcgtggagcgaagcagtggtaagttcatgaggagtttcagattgccagataatgctaaagtggatcaagttaaggcttccatggaaaatggggttctcactgtaactgttccaaaggaagagattaagaagcctgatgttaaggccatagaaatttctggttaa

SEQ ID NO: 3751 - DNA, 219 bp, Glycine Max
atgtgcaaattagaagtcacaagatccaccaagataagtatgctgataagcagaatgacgaaaagaattttggagacatttgtgttgctggggattggggaagaggccaaggcatttaacagtagtgtgcctggtcaagtcctcgtgtggacaacaaacactgtttatctactttgcatggctactgtgtgcatgcaacattctggctcggcatactag

SEQ ID NO: 3752 - DNA, 1290 bp, Glycine Max
atgtgcaatatccttggcacaattatggagaactatcaaggtgatttaagtgacataattcgtgctagtggtgcatcatatggcagttgcagcacgggaacttcatcatctgaagctgctaatcccttctctcgtaattatcacttgcagttctcttctgatcccatgattttctcttctgttttggaagggtttaatagcaactttggtgatccattttcaaacatgagagatccctttctacacgagcttgatttgcctctctctgcctattttaatagcacaagttcatctgcagaaattaagagttctggggcattggaagaagcaacttgttttggtggtggggttgttgctggtagtagtagtagtagtaatagttgtgttttggcacagaagattcttgatgaggatgatatgagaaggccatgtaacagcatattgtcaaacatgattcagatctctcccaatgataagttacccatctcgccagtggtggattctttgtcaaggccattcaagccttctggtgcggtttcaggtcacaacatgattgatgcaaagacctcttcagattattgcttggtggacaacacaaaagtgcagatctcatctccaaggaatccaggtcttaagagaagaaagagcctggcaaagaagtcgatttgtgttcctgcaccagctgcaccaaacagcagacaaagtggcgaggtagttccttctgatctgtgggcttggagaaaatatggtcagaaacccattaaaggttctccatatccaaggggttactatagatgcagcagctcaaagggttgtcctgcaaggaaacaagttgagaggagcagaacagaccctaacatgttggtcattacttacacgtcagagcacaaccatccatggccaacacacagaaatgctctcgctggttcatctcgatcccaaccatcaaaaaacaacaacattgctgcttcaaagaatgaggaagaagaggaggaggagagcaatagtgacagcaataaagtaaataacaatgtctttgtgagggaggaagagaagcagcttgagatggatgatgtagaattctgtgatattggagtcccttattacaggccaatatctaagatgaataactacctacaacttgatcagggcttgtttgcagaatttggagaaatagaaaaggatcagtcagtaaacctattgtctccaccacaaggttttgatgatcagcaaagggaatccaacgctttagattcattccatttctttgactggagaggtgatatttaa

SEQ ID NO: 3753 - DNA, 739 bp, Glycine Max
atgtgccaaaacaatatccaatcagatttatacacattctgttgtgtgtttaactcaattgctgctttgaagtgtctgaaatcattaagggagactcatggaatggctttgaaatgtggattcgatgcaatgcagattagtgcaaccaatgcccttgctgatgcatatgccaaatgtgactcacttgaagctgtagaaaatgtattcaatagaatgcaagggaaagacatagtatcttggacaaccatggtgacagcatattgccaatattctgaatggggaaaagccctggccatcttctcacaaatgcgcaatgaaggctttgtacccaatcattttaccctttctagtgtgattactgcatgtggaggtctttgtttactagaatacggccagcaaattcacggtctgacatgcaaggccagcatggataccgaaacatgcatagaaagtgctctaattgacatgtacgccaaatgtggcaatctaaaaggggcaatgaaaattttcaaaagaatatccaaccccgacacggtttcatggactgcaataatatccacttatgcccaacacggccttgttgaagatgcccttcaactcttcagaaagatgaaacagtcagatgcaaagatcaacgctccatggaggaaaggtggaggaaggcctgagaattttccatcaaatggaggacacctatggtgtggtgcccgaaatgaagaatcagtacctattgataatg

SEQ ID NO: 3754 - DNA, 1137 bp, Glycine Max; identical to SEQ ID NO: 533

SEQ ID NO: 3755 - DNA, 736 bp, Glycine Max; identical to SEQ ID NO: 534

SEQ ID NO: 3756 - DNA, 1743 bp, Glycine Max
atgtggagtttcactttctttgaacgagtttctagagctttccgtgatcatgggtccaacttcaagcttgtacttctctgcaccaccgtaagtggtggaggggttctggcttacggagaggctgtagccgcatctgaagcagcggcgacgaccacggagaagaagaaggtggtggtactgggaacagggtgggctggcacgagtttcttgaggaatctggacaaccccaaatatgaggttcacgtggtgtcccctcgcaattactttgcattcactcctttgctgcctagtgttacctgtggcaccgtcgaagctcgcagcattgtcgaacccgtccgcaacattttcaggaagaaaaagatggacatgcaatttagtgaagcagaatgtctcaagattgatgcaacaaacaggaaagtttactgtcgatctaatataagtaataatttgaacgagaaagaagagtttgtggtggactatgactacctaatcatagccgtgggagcaaatgtcaacacatttaatactcctggagtgatggagaattgtcatttcttgaaggaagttgaagatgcacagaagattagaagaaccgttattgactgctttgagagagcaagtttgcctagtgtaagtgaagaagaaaagaagagaattcttcattttgctattgttggaggtggtccaactggagtggagtttgcagcctcactacatgactatgtcactgaggatttggtcaacatatatcctgggataaaagatctagttaaaattacacttctggaggctggagatcatattttgagcatgtttgacaaaagaatcactgcttttgctgaagagaagttcggaagagatggtattgatgtgaaaaccggatccatggttgtgaaggtttctcagaaagaaatttctactaaagaaatgaaaaatggaggagcaattactacaattccatatggaatggctgtctggtcaactggtattggcactcgtccatttataagagattttatgtcacaaattggtcagactaacagacgagccatagctactgatgaatggttgagagttgaagcaacaaacaacgtgtatgcacttggtgattgtgccacaataaaccagcgaaaagtcatggaagatatcgcggcaatatttaagaaggctgacaaagacaattcaggaactcttactgtcaaagaatttcaggaggtattggctgatatctgtgagagataccctcaggtggagctatatctaaagagtcaacagatgcacaacattgctgatttgttgaaaggatccaaggaagatgttgaaaaagaatctattgaactgaatatcgaagaactcaaaaccatactctctaaagtggattcccagatgaaatttcttcctgctacagcgcaggttgcatctcagcaaggcacctacctggccaagtgctttaaccggatggaagagtgtgagaaaaatccagagggtcctatcaggttcaggggagaagggcgccatcgcttcaaaccctttaggtacaagcatttaggtcaattcgctcctctaggaggagagcaaacagctgcacagcttcctggggattgggtttcaattggacacagctctcaatggttgtggtattctgtctatgcaagcaagcaagtcagctggcgcacaagggcattagtagtatcagactggacaagacgctttatttttgggagggattcaagtcaaatctga

SEQ ID NO: 3757 - DNA, 777 bp, Glycine Max
atgtggatggttggttacaatgaaggagctgagttcaacatggccgattatggattcaatggaaggaaactaaggcctctcatgccaaggccagtcacttctcctaacaatacttcaaacactaactctccatacttgacccgcattcatcatggcaacgatttcttttcacagtatcacaatcttgcatcagtggcagatcagggaaagagagagttcaaccctccaccagtagtggtgagttcaaggtggaatccaaccccggagcaactgagagcattggaggaattgtatagaagagggacaagaacaccatctgcggagcaaatccaacaaatcacggcacagcttaggaggtttggaaaaattgaagggaagaatgtcttctattggtttcagaatcacaaagcaagagaaagacagaaacgccgccgtcaaatggatactcttgaaaagaagacttcggtaacttgtttctttgcgggcatgaaagagacaagtaacaagaggccttgttttgcaatgcatgggctgatggcttcttttgcgcaagtaggacagtgcttgaagttgaacagaccaagaactgggcaccctctacaaactgcagtactcttgcagaggtctattattctacatcctcctttgtctttgtccttgttcatggactgtttaattttttgttataccatgcaactttatttgaaactaggagtgcatgccaatttgaaatctgtgctgctgtccaataataacttttttacctttgctctttgg

SEQ ID NO: 3758 - DNA, 1311 bp, Glycine Max
atgtggcctacattagtggctaataagatattcaagaagagacttggaagcagcaattttatagcggattatcctagttataaagaacccttgctgggtattgtagacattgatcagaactcaaaaaccattcttaatgatcacaaggactcacacaaatacaaggtatttgttagtacatggaacgtaggtgggattgcaccggatgaagatttgaatatagatgatttgttggagacatgcaacaactcttgtgacatctatatactagggtttcaagaaatagtgcctctaaaagcatcaaatgtattggggtccgaaaacaatgagatttctatgaaatggaattccataatcagggaagccttgaacaagaaaataacacatcaaagggacaaagatgctaaaaaacaggagctaaagaataattttcccaataagaaagaaaatccagctaagtgctgtgatgccccacatgatttccaatgtatcattagcaagcaaatggttggattattcatatctgtgtggattagaagagatctttgtccattcattcggcatccaagcgtgtcatgtgtaggttgtgggataatgggctgcttaggaaacaagggttctatatcagtgagatttcagttacatgaaaccagcttctgctttgtgtgcagccatctagcttcagggggcagagaaggggatgagaagcacaggaactctaatgttgctgaaattttttctcggacaagttttcctagaggccctttgcttgatttgcctagaaccattcttgatcatgatcatgtaatattgcttggagatctaaattacagaatttctctaccagaagaaaccacacgcttgcttgttgaaaaaagagactgggattctttattagcaaatgatcagctaataatggagctaatgagtggaaacatgttaagaggatggcacgaaggagcaattaaatttgcacctacctacaaatattgtccaaattcagacatttactatggatgctgctatcatggcaaaaaggcagaaaagagaagagcaccagcatggtgtgatcgaatagtatggtgcggtgagggtctaaagcaacttcagtacactacaattgaatcaaaactatcagatcataggcctgttaaggcaatgtttatagcagaagtcagggttttaccagagctgatgaaaaacttgcaaagcttgttcctatcagaaagatacgagcaaattaaaactccctttgaagtttccaccactgaagattttgtaaatagaaaacgatcaagcttccggttgtga

SEQ ID NO: 3759 - DNA, 2502 bp, Glycine Max
atgtggcctgatttgattgcaaagagcaaggaaggtggggcggatgtgattgaaacttatgttttctggaatgggcatgagccagtgagaggacagtataattttgaagggagatatgatcttgtgaagtttgtgagactagctgcatcccatggactctatttctttctccgcataggcccttatgcgtgtgccgaatggaactttgggggtttccctgtgtggttgcgtgatatccctggtattgaatttcgaacaaacaatgcacctttcaaggaggagatgaagcgctttgtctccaaggtggtgaatctgatgagagaggaaaggctgttttcttggcaaggtggtcccataattttgttgcagattgagaatgaatatgggaacattgagaattcctatggtaaaggaggtaaagagtatatgaaatgggcggctaagatggctctaagtcttggtgctggggttccatgggtcatgtgtagacagcaggatgctccatatgacattattgatacatgcaatgcatactactgtgatggatttaaaccaaactctcataacaaaccaacgatgtggacagagaactgggatggatggtatacacaatggggtgaaagattgcctcatagacctgttgaagaccttgcttttgcagttgcacgttttttccaacgtggaggaagctttcaaaactattacatgtattttggcggaacaaattttggccgcactgcagggggacccttgcaaattacaagttatgattatgatgctccaattgatgagtatggtctgctgcgtgaaccaaaatggggtcacttgaaagatttacatgctgctttgaagctttgtgagcctgccctggtggccactgattcaccaacatatataaaattgggtccaaagcaggaggcacatgtgtaccaagcaaatgttcaccttgaagggttaaacttgtctatgtttgaatcttcaagcatatgctcagcatttcttgccaacattgatgaatggaaagaggcaactgtgacctttcgcggtcaaagatacactataccaccatggtctgtgagtgttttgccagattgcagaaatacagttttcaatactgccaaggttagagcacaaacttctgtcaaactggtagagtcttatttgccaactgtctctaatattttcccagcccagcaattgaggcaccagaatgacttttactacatctcaaagtcttggatgactacaaaagagccactcaatatatggagtaagagcagtttcactgtagaaggtatatgggagcacttaaatgttacaaaggatcaatctgattacctttggtattcaaccagagtatatgtttcagatagtgacatcttgttttgggaggaaaatgatgtccatccaaaacttactatagatggtgtccgtgacatattgcgtgtattcatcaatggccagcttataggtaatgttgttggtcattggatcaaggtggtccagactcttcaatttctcccaggatacaatgatttaacactgttaactcaaacagtgggtttacagaattatggcgcttttcttgagaaggatggagcagggattagaggtaaaataaagatcactggatttgaaaatggagatatagatctttcaaaatcattatggacctatcaggttgggcttcagggtgagtttttaaaattttacagtgaagagaatgaaaattcagaatgggtagagttgacccctgatgccatcccatccacatttacatggtacaagacatattttgatgtccctggtggcatagatccggttgctctagacttcaaaagcatgggaaaaggtcaggcttgggtgaatggtcaacatataggaagatactggactcgggtttccccaaaaagtggatgtcaacaagtctgtgattatcgtggagcatataattccgacaagtgttcaacaaattgtggaaaaccaacccaaaccttgtaccatgtgccacgatcatggttgaaagcaaccaacaatttacttgttatcttagaggaaaccggaggaaatccctttgaaatttcagttaagttacattcgtccagaataatatgtgctcaagtgtcagaatccaactatccacctttgcaaaagttggtgaatgcagatctcattggtgaagaagtttcggcaaataatatgatacctgaactgcacttacattgtcaacaaggacacacaatttcctccgtagcatttgcaagctttggtactccaggaggtagttgtcagaatttttctagaggaaactgccatgcacctagttcaatgtcgatagtttctgaggcttgccaagggaaaaggagctgctccatcaaaatctcagacagtgcattcggggtagacccgtgtccgggtgtggtgaaaacattgtcagtggaagcaagatgcacatcaccattgagtgatgacttctttcaagaggctgttagcagcttctaa

SEQ ID NO: 3760 - DNA, 891 bp, Glycine Max; identical to SEQ ID NO: 535

SEQ ID NO: 3761 - DNA, 972 bp, Glycine Max; identical to SEQ ID NO: 536

SEQ ID NO: 3762 - DNA, 912 bp, Glycine Max; identical to SEQ ID NO: 537

SEQ ID NO: 3763 - DNA, 900 bp, Glycine Max; identical to SEQ ID NO: 538

SEQ ID NO: 3764 - DNA, 900 bp, Glycine Max; identical to SEQ ID NO: 538

SEQ ID NO: 3765 - DNA, 654 bp, Glycine Max
atgtggctttcttcaaaagcttactacagtccaattgttgaattgtgtggaggcactgagctcgcatctagctacattgcaggaagtcccttgcagcctcaagcttttggagcatttagcacagcatcaatgacaactggttttgtcatttttgacgaaaatggagttccttatccagatgatgttgcttgtgttggggaagtgggcttatttcctctctctctgggagcatctgacagattgcttaatgctgaccatgagaaggttactttaagggaatgcccatttataaagggaaggggtgatgacaccatgaatcttggaggaataaagacaagttctgtagaaattgagagtgtctgtgatggagcggatgaatgcattttggtgacagctgcagttggtgttgcaactgcaaatggaggcccagaacaactggttatatttgtagttttaaaggaaggatacaattccagtgcagaaactctaaagatgaaattcactaaagctattcaaagcaaccttaaccctttgcttaaggtaagccttgctaaaattgtgccagagtttcctgggacatcttccaacaaaataccgaggagagtaatgagggatcaaatgaagcgtgagctatcagtccagagcagactttag

SEQ ID NO: 3766 - DNA, 2019 bp, Glycine Max
atgtgggaatcagagagtgagtctggtgcaggaagggaatatgggagtggacttctcacttcaaccaagcacagtctcaagactgagggatttcagcaaagaggcaactgttggtatgtttcaactgatattccaagtgatcttcttgttcaaattggagatgcaaacttccatttgcacaagtatccattgctatctcgaagtggaaagctgaacagaatcatatatgattcgcgcaaccctgacttgaataagatagttatggatgatctccctggagggcctgaggcttttgaacttgcatccaaattttgctatggaattgcaattgatttaacagcaggcaacatctctggccttagatgcgccgcagagtaccttgaaatgacagaggacctagaagagggcaatcttatattcaagacagaagcctttcttagctatgtggttttgtcctcatggagagactccatagtagtgttgaagagctgcgagaagctgtctccgtgggcggagaatcttcaaattgtgagaagatgcagtgagtccatagcatggaaagcatgtgccaatccaaagggaataaggtggtcatacactggaagggtaccaaaagttgcaagtccaaaatggaatgacatgaaggactcaagccctagtaggaaccagcaggttcctcctgattggtggtttgaggatgtttcaatccttaggattgatcactttgttagagtcatcactgctatcaaggtaaagggtatgaggtttgagatgattggtgctggaataatgcattatgcaattaagtggctacctggtttgatgaataaggacacatcaatcccaggagaagaaggaagcaatagtagtactagtaacagtatttctagtagtggtggtagttggaaaggtggacttcatatgattgtggctggacctagagatgacacttcaactcttcaagctaaagatcaaaggatgatcattgagagcctcatcagtataattcccccacagaaggatagtgtctcatgcagcttccttctcaggcttctgagaatggcaaacatgttgaaggttgcacctgcattgattaccgaactggagaaaagggttggaatgcagtttgagcaagctacactggctgatcttctgatcccatgttacaacaaaaatgagactacttatgatgtggatcttgttcagaggctgcttgagcattttcttgttcaagagcagaatgaaagttcaagcccaagcagaccaccctttcctgacaagcatgtgagcagtaacattaatgctaagacaagagtggcaagacttgtggacagttatcttactgaggtttccagagataggaacctttctctcacaaagtttcaggttctttcagaagctttgcctgagtcagctaggacttctgatgatggactctacagagcaattgattcctatcttaaggctcatccaacactaactgagcatgaaaggaaacggctctgccgggtaatggattgtcagaaactctccattgatgcttgtatgcatgctgctcaaaatgaaaggcttccattgagggtagtagtgcaagttctcttctctgaacaggtgaagataagcaatgcactagccaacaacggttctctgaaagaaggtgctgaatctcactaccagccaatgattccaaaccggaaaacgcttctcgaagggacgccacaatcattccaagaaggatggacagcagctaagaaagacatcaacacactcaagtttgagcttgagactgtgaaaaccaagtacttggagcttcaaaatgacatggaaaacctgcagaaacactttgataagttgctgaagcagaagcacagttcagcatggagcagtgggtggaagaaactaagcaaactcacaaaaatgactaatgtggaaaatcatgatatttcacctcagattccaacttcagaagaacagaacagaaagacaacaactagaaggtggagaaactcaatatcctga

SEQ ID NO: 3767 - DNA, 1008 bp, Glycine Max
atgtggggtcttcaacaatttattgtttgcaattgtaatcgtttgaatttcattgtgttggttttgacagggtttcaggtgtgccactctttggggggtggaactggctcgggcatgggaacacttctcatctcgaagataagggaagagtaccctgatcgtatgatgttgactttttccgtttttccttcccctaaggtgtcggacacagttgtggagccgtacaatgccaccctttctgtgcaccagctcgttgaaaatgccgatgaatgcatggtcttggacaatgaggctctctatgatatctgttttcgtaccttgaagctcgctacaccaacttttggggaccttaaccacctcatttctgctaccatgagcggagttacttgttgtctacgtttccctgggcagctgaactctgatcttaggaagcttgccgtgaatctgatcccattccctcgtctccatttcttcatggttggatttgcacccttgacatcaagaggatcccagcagtaccgcaacttgactgtgccagaactgactcagcagatgtgggattctaagaacatgatgtgtgctgcagatccacgccacggtcgttatttgaccgcatccgcaatgttccgtggtaagatgagcaccaaggaggtggatgagcagatgatcaatgtacagaacaagaactcttcctactttgtcgagtggattcccaacaatgtcaagtctagcgtgtgtgatatcccaccaaagggccttaagatgtcatccactttcattgggaattcaacatcaatccaggagatgttccggagagttagcgagcagttcacggcgatgttcaggcgcaaggctttcttgcattggtacaccggtgagggaatggacgaaatggagttcaccgaggccgagagtaacatgaatgatctggtggcagagtaccagcaataccaggatgctactgttgacgaggaagagtatgaggatgaagaggaggaggaggcttaa

SEQ ID NO: 3768 - DNA, 987 bp, Glycine Max; identical to SEQ ID NO: 540

SEQ ID NO: 3769 - DNA, 1380 bp, Glycine Max
atgtgggtgttctatatgttctcattgcccgtggccgttggcatggttattgttacattgaaatatttctctggacctgatgtacccaaatatgtgttcttcaccgttgcatacacatggttctgctccctctccatcatcatcctcgtccctgctgatatatggacgtcactaaatgatgatgaaaatgaagcaatttccttcttgtggagtttgacatattggagtaccttcttacttacatgggctgtggttcccactattcagggttatgaagatgctggagacttcacagtgaaagcaagattgaggaccagcttacatggaaaccttgttttctatctgtgtctcggttctgtagcactctttggattgatattactaatttctttgcacaaaaattattggagtggtaatgttaccggttttgccatggcttgctctaatacatttggactggttaccggtgcatttctacttggatttggtttgagtgaaattccaaaaggcatttggttaagtgcagattggaacattgagcaaaaagttctttcacataaagttgcaaaaatggctgtcaaattagatgatgctcatcatgatttttcaaatgctattgttatcacccaggcaacatcgaagcaaatgtccaagcgggattctttgagaccctacatgaatataattgacaaaatgttgcttcagatgttgaaggaagacccctccttcaaaccacagggtggaagactaggagaaagtgacatggattatgatacagatgataaatctatggcagcactaagacgtcgtcttaagagagctcgtgaacagtactatcgatatagaagtgaatatacaaaatttgtcgtagaagcccttgagctggaggataccataaagaattatgaccgacgtgatgctacaggatggaaatatttttcatgcttgaggcctgaacgcataggcaaagtaggtgcacttttggatacaatagagtttctatggcgatgtatattatggaaacagcttgagaaatcattggctgttatattgggctgcatgtcatttgcaattctattagcagaggctaccatactcaccagtggagttgatttatcccttttctctatcctagtacatgctggagggcagcaagaggtgcttgtacagttggctgctttcatccccttaatgtatatgtgtatctgtacatattattccttgtttaaaatgggaatgatgatgttttactcactgacaccaaaacaaacaagctcagtaagcctgcttatgatatgctcgatgattgcaagatatgcagcacccatttcatacaactttctcaatctcattaatcttgaaaatgggaaagatcaatga

SEQ ID NO: 3770 - DNA, 2118 bp, Glycine Max
atgtgggtgttctatatgttctcattgcccgtggccgttggcatggttattgttacattgaaatatttctctggacctgatgtacccaaatatgtgttcttcaccgttgcatacacatggttctgctccctctccatcatcatcctcgtccctgctgatatatggacgtcactaaatgatgatgaaaatgaagcaatttccttcttgtggagtttgacatattggagtaccttcttacttacatgggctgtggttcccactattcagggttatgaagatgctggagacttcacagtgaaagcaagattgaggaccagcttacatggaaaccttgttttctatctgtgtctcggttctgtagcactctttggattgatattactaatttctttgcacaaaaattattggagtggtaatgttaccggttttgccatggcttgctctaatacatttggactggttaccggtgcatttctacttggatttggtttgagtgaaattccaaaaggcatttggttaagtgcagattggaacattgagcaaaaagttctttcacataaagttgcaaaaatggctgtcaaattagatgatgctcatcatgatttttcaaatgctattgttatcacccaggcaacatcgaagcaaatgtccaagcgggattctttgagaccctacatgaatataattgacaaaatgttgcttcagatgttgaaggaagacccctccttcaaaccacagggtggaagactaggagaaagtgacatggattatgatacagatgataaatctatggcagcactaagacgtcgtcttaagagagctcgtgaacagtactatcgatatagaagtgaatatacaaaatttgtcgtagaagcccttgagctggaggataccataaagaattatgaccgacgtgatgctacaggatggaaatatttttcatgcttgaggcctgaacgcataggcaaagtaggtgcacttttggatacaatagagtttctatggcgatgtatattatggaaacagcttgagaaatcattggctgttatattgggctgcatgtcatttgcaattctattagcagaggctaccatactcaccagtggagttgatttatcccttttctctatcctagtacatgctggagggcagcaagaggtgcttgtacagttggctgctttcatccccttaatgtatatgtgtatctgtacatattattccttgtttaaaatgggaatgatgatgttttactcactgacaccaaaacaaacaagctcagtaagcctgcttatgatatgctcgatgattgcaagatatgcagcacccatttcatacaactttctcaatctcattaatcttggtgggggtagaaaaacaatttttgaacaaaaaatgggaaagatcaatgacgctgttcccttttttggaaaaggattcaacaaaatttaccccctcatcatggttgtatacacttcactaatagcaagcaatatttttaaccgggtcatcaagtattgtgggaattggaaaatattcaagttcaatgatgatgcagaagatatggatggatttgacccatccggagtaataatattgcagagagaacgttctcttctccaacaagggcacaaagttggtgaacttgtttttcctttggcaaggagtttcagtgtgactatggatgtcgagtccaacagcaaggccatggctctgaatgagagtgccactaccaacatagtggaagagaaaaatgaaggcactcagaaagacatgagcagaaaaattggcagcaaaaagtatgcagccttaaggacaaacttcaatgaagaggtgtctagtaaagatttgacccaggaaagagtttcttcctccttgacaagtgatgctaatgattctcagaacacaagttcagctccatcatctgcattggcctcaaaatgggaatcaatgatgcatggatttaaaagtttgagatctaacattgactccaagggattcctccctctttctaatgctcaagggtcaactctaaactcaaaatcttcatctgaatcccttgatgacatatttgagagattgaaacgtcctccttcagaatatagagattctggtgactga

SEQ ID NO: 3771 - DNA, 2163 bp, Glycine Max; identical to SEQ ID NO: 541

SEQ ID NO: 3772 - DNA, 1452 bp, Glycine Max
atgtggtacttgtgcgttttcttccacaggttattggattacagaaaacccgaagtggaatctctggcacaactcttcggagcaaccgaggacccccaaaacggcgacgtttcctcgcaattgcaatggaaactccctcatcactaccacgcagattcccctttccatttcgtcaacctcccttcggaacaactcgctcgaaacatcgctacccgaagcatacttgtgaaggggatgtatgagctgtggggtgaagggagtagctatgaggagttgaaggagtctgtgttgagttaccctgatgaaaggaagttgccgtacttggattctgatagcactttcaagataaccgttgattgctttgggaaggtcattagcttggaggagcaaaaggagctcattcaagggctctcttatatccctttcaagggccgagtaaagttgaaaaacccggatcacaacttctggcttatagaagttgataactatggaggtaataatggtcttcctccaattgtacaaaagagagtcttctttggtcgcgaagttggtggggcagataggaagcttttacccacatatcagttgaaaagccgtacttatcttgggccaacagccatggatgctgaaattgcttttctaatggccaatcaagcactagctacttctgggaaactagtttatgacccttttgttggaactggaagtattcttgttgcagcagctcattttggagcaatgaccatgggtgctgacattgacattagggtagtccgtgatggacgtggtcccaactgtaatgtttggagtaattttaagcagtatggattgccaatgcctgttggtcttctaagagcagacaacaaccttcctccctggcgttctacgctgaaagaggtatttgatgccataatttgtgatcctccttacggagtgcgagctgggggacgcaaatctggtggtcggaagctgctaaagggggctgtggaaccttacactgttcctgatgaaaaaagaacaaatcacataccatcaactgcagcttacagtttagttgagtgcgtgcatgatttgcttgatcttgcagccaagatgcttgtaatggggggcaggcttgtgtatttctatcctgtattgagagaagatggttttgcagaaaaccatttcccagagcacccatgttttaaactgatttcttcatcggagcagatccttagttcacgatatagcagggtgttactgacaatggtcaagacaggtccttacacagaggaaatagctgaggcggctagggaaaaacacattgaatttaaggagaaccatgtaaaatggttagaagatggtaatcttcattctgcagttttcagtcctgctgatgctcagttaacggaggctggtgatcccaagttaattaaggatccaaagcctaaatacagaggaaagtatgtttag

SEQ ID NO: 3773 - DNA, 1176 bp, Glycine Max; identical to SEQ ID NO: 542

SEQ ID NO: 3774 - DNA, 1203 bp, Glycine Max
atgtgtagctctaagaccaaagtgactgttggtttagaagccgttgtcgctgctgcgaagccctcagtggctagaatcaatggaaggccagtcctccaaccaacttgtaaccgtgttccaaaccttgagaggaggaattcaatcaagaaagtggcaccaccaaagtcactttctccaccatcaccaccacttccaagcaagacctcattgacacccccggtttctccaaagttaaagtcccctaggcttcctgccacaaagagaggcaatgacaacaatggacttaactcgagttatgagaagattgtgatccctagaagctccacaaaaactccaactttggagagaaagaagtccaagagcttcaaggaagggtcatgtgtgtctgcttccattgaggcttcgttgagttactcgtcttctttgatcactgactccccaggtagcattgctgctgtgaggagggagcagatggcactgcaacaagcacaaaggaaaatgaagattgcccattatggaagatcaaagtctgcaaagtttgaaagagttgttcctcttgatccttcaaacactagtcttgcatcaaagccaactgaggaggagaagagatgcagctttatcacacccaattcagatcccatctatattgcttatcatgatgaggaatggggagttccagttcatgatgacaagatgctgtttgaacttttagttttgagcggtgctcaagttggatctgattggacctcaaccttgaagaaacgcctagatttcagggctgcattttcagaatttgatgcagaaaccgtggctaacttgactgataagcaaatgatgtctattagttctgaatatggcattgacataagcagagtccgaggagttgttgataatgctaaccaaattttagagattaagaaagactttggttcatttgacaagtacatttgggggtttgtgaatcataaaccaatctccactcaatacaagtttggccacaagattccagtgaagacatcaaaatcagagagcataagcaaagacatggttagaagaggctttaggttcgttggtccaacagtggttcattcattcatgcaaacatctggcctcacgaatgaccacttaatcacatgccacaggcacttgcagtgcaccctattggcagctcgatccctttgtaccatagagccctctcaatag

SEQ ID NO: 3775 - DNA, 360 bp, Glycine Max; identical to SEQ ID NO: 543

SEQ ID NO: 3776 - DNA, 624 bp, Glycine Max
atgtgtttcacattcacttttcagttcccactccctttctctctccccaacccaaaaatggcatcaaaattgaccctcattgcgttggttctcgcggtggccctgtgcgccgttgatctaacccatagcgcatcagcatcctcccctcacgcgccagcgccctccgtggactgcaccaacctcgtcctcaccatggccgactgcttgtccttcgtcaccaacggtagcaccgtcaccaagccagagggcacatgctgctccggtttgaaatctgttctcaaaactgctccggcgtgcctctgcgaggctttcaagagcagcgctcagttcggcgtcgttttgaatgtcaccaaggccacctctctccccgccgcctgcaaagtttctgctccttctgccaccaactgtggattgtctgaaacgcctgctgctgctcctgctggaggcctctctccacaagcttctccatctcctcaacaagcagatgcttcaactaatggtcctgtaaatgagatatctccagcaccagcaccagcccaagggaacacagcatcagcattattcccaatttctgctgggtccttgcttcttggcatattggtagccacattctcaggcttctga

SEQ ID NO: 3777 - DNA, 1317 bp, Glycine Max
atgttagacaacaacaattgcagtgcttctaattctggtgcaccatcttcttctgatgccgcctttgcattatctgaaaatggggtggctaacaacaaaaggaaaagaagacccgcaggcacacccgatccagatgctgaggttgtgtctctctcaccaaccaccttgctggaatctgacagatacgtgtgtgagatctgcaaccaagggttccagagggaccagaatcttcaaatgcacaggaggaggcacaaggtgccatggaagctgctaaagagggaaacagcacaaggggggcatcagaagaagagggtgtttgtgtgccctgagccaacttgtttgcaccatgacccttgccatgcccttggggaccttgtgggaatcaagaagcacttcagaaggaagcacagcaatcacaagcagtgggtctgtgacaagtgttccaaagggtatgctgttcaatctgattacaaggctcacatcaaaacctgtggcaccaggggccattcctgtgactgtggccgtgtcttttccagggtggagagtttcatagaacaccaagatgcatgcactgtccggcagcaccggccagagttacaagcacttcaaccagcatgctcttcaagaacagcttcaagcgcaagtccctctagtgaggcaaattttagcatagccccaccattgcaaggacttccagtactgccaaaaccagctgaacaacaacaacaaccagcaacaacaacagtcttattaacttcagagatacacggtaacaagtccactacctcgcataacttagaacttcagctcttaccctcctcaacaaactctcaagcaaaacgaaatacaaaggaaaactatggcttgaaactttcaataggctcatgtagtaacgacaaagggaatagtagtgaaccaccagagagagcatgttcagaagcacataggagcccacctgaaaggaataataataataataataacaatgagtttgcaggagaggaactcaagttggccattgcagaaaaggcttatgcagaagaggctagaagagaggccaaacgtcaaattgagatagctgaacttgagtttgagaatgccaaaaggataaggaaacaagcacaagctgaactttcaagggctgaagagctgagaaagcaagccatcaagaagataggttccactgttatggaaatagcatgtcatacttgcaagcaacagtttcagtcttcaactgttggggtgccatcatcagaagaaacctccattgtgatgagttacatgtcctcagccaccacagaaggagaagcagaatga

SEQ ID NO: 3778 - DNA, 1383 bp, Glycine Max; identical to SEQ ID NO: 544

SEQ ID NO: 3779 - DNA, 162 bp, Glycine Max
atgttagcaccggcacccttgaacaaggacttggcgccctcattcttgaggatctgtgtgaatgcgtccaaggaactcttgtacttgacagcttcaccagaggtcatcatcattcttcttctaacagtgtcaattgggtatgatgcaagacctgcaccattg

SEQ ID NO: 3780 - DNA, 1965 bp, Glycine Max; identical to SEQ ID NO: 545

SEQ ID NO: 3781 - DNA, 708 bp, Glycine Max
atgttagttgggattccaaatgttggaaagtcggcacttgtcaatgctttgcatcaagtggggagaatcagtgcagcagaaaaaggaaagttaaagcatgcaactgtgagtccagagccaggggagactaaagacatacgaagttttaagattggtagccatcccaatatctatgtgttagacactccagctattttatctcccaaggttcctaatgttgatattttatctaaattaattttaacaggagcaattggggattgtttagtcaggagaaaagaagttgctcaacattttctagctattcacaactctagtgagcaatacaagaaatgggcaaaattgtctatgaaggataatgatagattattccttaacgggacaacagaacagttgactagctctgggttgcatatgaagcataaaaaccaaatccctacagatcacacacaggactgcgtagtgcaggatgttcgacgaacactgtttgaaacaatttcatcattcgaaggtgatgtgagatgtgaagacgaaatggaagcacttattgcaaggcagtttactgccttgcaggaagctttccatgtttcaattgaatctgaagaagatgatgctcatgacaaggttgctgggaagttgcttaatcttttccgtactggtcgtcttggacattatattttagataatcttcccggatatattcaatga

SEQ ID NO: 3782 - DNA, 1581 bp, Glycine Max; identical to SEQ ID NO: 546

SEQ ID NO: 3783 - DNA, 1533 bp, Glycine Max; identical to SEQ ID NO: 547

SEQ ID NO: 3784 - DNA, 288 bp, Glycine Max; identical to SEQ ID NO: 548

SEQ ID NO: 3785 - DNA, 1278 bp, Glycine Max; identical to SEQ ID NO: 549

SEQ ID NO: 3786 - DNA, 1398 bp, Glycine Max
atgttccgccaccgcttcctcctcatactgtaccccgcacaaggccacatacaccccgcattccaactcgctaagagactcgttagtttaggcgcacacgtcactgtttccaccaccgtccacatgcaccgtcgcatcaccaacaaacccaccctccctcacctctcctttctccccttctccgacggctacgacgacggtttcacctcctccgatttctccctccacgcctccgtgttcaagcgccgcggctccgagttcgtcaccaatctcatactctccaacgctcaagagggtcatcctttcacttgtttggtctacaccacactcttgtcttgggtcgctgaggtggcgcgtgagtttcacctcccaacagcgatgctgtggactcaaccagctacgatactcgacatcttctattactactttcacgaacacggtgaatacatcaaagacaaaatcaaagacccctcgtgtttcattgaattaccaggattgccattgttgcttgcaccacgggacctaccctcttttttattgggttcaaaccctactattgactctttcattgtcccaatgtttgaaaagatgttttatgatcttgacgtggagacaaagcccagaatacttgtcaacaccttcgaagccttggaagcggaggctctcagagccgttgataagttcaacatgatcccaatcgggccgttgattccctcggctttcttggatgggaaagatactaatgatacttcatttggcggtgacatcttccgcctctctaatggttgcagcgaatggttggactcgaagccagagatgtcggtggtttatgtctcgtttggtagcctttgcgtgttgcctaagacgcaaatggaggaacttgcacgtgcgctattagattgtggaagtcctttcctgtgggtcattaaagaaaaagaaaataagtcacaagtggaaggaaaagaggagctgagctgcatagaggaattggaacagaaggggaagatagtaaactggtgttctcaagtggaggttctttcacatggttctgtgggttgttttgttacacactgtggttggaattcaaccatggaaagcttggcatctggggttcctatggtggcatttcctcagtgggtggaacagaagactaatgcgaagctaatagaagatgtgtggaagacaggggtgagagtggataaacaggtgaatgaggatggcatagtagaaaatgaagaaattaggcggtgtttggaagaggtgatggggagtggagagaaaggacaagaattgagaaacaatgcagaaaagtggaggggactggccagggaagctgtcaaggaaggtggctcttcggataagaatctaagggcttttttagatgatgttgaagtttga

SEQ ID NO: 3787 - DNA, 2966 bp, Glycine Max
atgttcggcgcccgagcgcgaaccctctccagcaccatcatttccttgctccctccgccgtctccgccggcgctttgccactgccgcggccgcggttgcctcggctgcgccgtcgacgcggagaagtttcttctccgccccgaggatccctcggactaccgcgaactgctctcgaaatgcttcgtcgccgttccaagaaacgcgccttcgccgctcccgttcttctctccgctctcctcccgcttgtcccaatatatgattgtacggaggaccattgaaccgatgctgctgcttcgaaatgaatcttccaatgtgttgtgttctggttatgatccggttatctgtgtcatttttactctccggcattattcttttttgttgtttctgttgctgcttttccattatgagggtattcttaatgttggattagatgtttcaaggagttacaatgaaatagagttcattagtgagaatacaagctattcacttattggttttgggcctgtgctgatacaccctgaagggtttatcccacttagtagcccggttcctatcaggttgaagccaaatttggcttattcaaagcatctcattgacgatatttttggcttctcaaatgcccagataataccttgtttgcacagcaatggctcatgtctcattgactctggatgcctgtatcactcccttgttaagtggtttaagcatctcattcgtaggacacgctattgccagcatacaaagctcttgaataagcattgtgttgtttcatcatttgatttggataaaaatacaatcggaagttctaaataccatgcagatactgtggaaacaatagattcaccatctgaggcatttaagtcatactgttcaaaaagtcaagttgtatcttttatatgggctgtttctaggagtttacttccttctgaattattaggtactcctcctacttggagaataatgaggagaaatatttccaagttcatacacttacggagatttgagaaattccctttaaagctatgtatgcacaaacttaaaatatcatcatttcctttcttatcaaataaatatttcttaaatagtcaaaatgcttctgttctaaagtatatagaagggaaaaataaattatttcatcaggaattcaagaattggaatgatgcagtccatggtgtcaaacacaagcttctggagaagtggatcttctggtatttctcttttctggttgtacctttggtgcaatcaaacttctatgttactgaaagtgagcaagggaaacaagatatttactattatccaaaaccagtttgggaaaagttggctgctagcactgttgcttgctttaaagactggagatacagttgcctggatgatgtggctgtacgtaatattcttagaggtagaaaatttgggttttcaaaacttagacttcaaccaaaagaaaatggagtaaggatggtggccaatctgaaaggttcttcaaaaatgccactgcttatgtccactatgggagttcgaaattggaaaacaaaggggaaggtaaaaaaccattccaagtataaacattatccgtctgtcaattctgttctccgtgatgcccatactatactaaaaggaattcggttcaaggagcccaacaaactaggatcttcagtgtttgactacaatgatgtttacaaaaaattatgcccatttttggttggccagaagaagggatcagcatctatgcctaatttgttcattgttaagtctgatgtgatgaaagcatttgattctattaatcaggacaagcttcttgatataatgaaagattttctactgaaagatgtgtattttcttaagcagtatgatgaagttgtttgcacaaagaagtctctgtgggttcaaaagcaatttacgatgctggatgaaacaagaaacaatagcgatacacaattcacttcatttgcttcctttcattcccatcatggtgtctttgttaaccaggaacgatggaacaccgtgaaaaagaaagctttgaatgcagatcttatgcagcatgtgaagcgcaatgtgttgcagtttaatggaaaattttacttgcaagatgttggtattccccagggaggggttttgtcatccttgctttgctccatgtattatggacatttggagagacatgtaatatttccgtttcttgaaaagactcttgaatgtggcagttgcacggagaataatgctgggcaaaccaattatgatgataaagtctcatcttacatgctaatgcgatttattgatgatttcctttttatatcaacctcaaagaagcaagcagctagctttttctccaggctagaaagaggttttcgtggttacaactgccacatgaataagaaaaagtttggtgcaaactttgatgtagaacatatatcagactgcccattgaacagggtttatgtgggggaagatgaaaaggtttctacgctagttaaacttgtagcttttaatcatatagttccatattatggcttttcagatgtaacgtacttgggtagccatttaagctcgacgcttactgttcgctggcaaggtaaaccaggcattaatctcaaggggaagctgcgtctctttctaagacctaaatgccaccctatattctttgattcaaatatcaattcagcagctgttgtgagattaaatatttatcaaatatttttgttatgtgcaatgaagttccattgttatatccgggatttatctttcatatgcaaactccacaaaagatattgttctaacatcatacaaatttctttgagatacatgtaccagctgataaagaaacaaatgcactccataagtcttaattcagaaattcagccgattcttgtattggagaaggaagaagtggaatggcttggacttcatgcttttgtacaagtactaaagagaaagcaatcacgacataaggagttgctggcaattttgag

SEQ ID NO: 3788 - DNA, 1002 bp, Glycine Max; identical to SEQ ID NO: 550

SEQ ID NO: 3789 - DNA, 1773 bp, Glycine Max; identical to SEQ ID NO: 551

SEQ ID NO: 3790 - DNA, 609 bp, Glycine Max
atgttctttactccaactataaattttctgacttcaaaggggcataatgttcaaatactttgcttatctataggtgatgcagatggcaaaggaaatatcagaaaacaagagctttttcaggcttgtgtagccctcaaggttccgatgcaacaagtgaagattgtcaaccatcctgatctgcaggatggttttggtaaagtttggaaccatagcttattggcaaagattattgaggaagaaataaccagtcgttgcattgatatgattattacctttgacagctatggtgtctcaggtcattgtaatcatcgtgatgtgcattatggagtatgcaagctactgcatgatattttacaaagggatattgaagtttgggagcttgttagcaccaatattttgcgcaaatatagtggtcctgttgatatctggttgtccatatttttgaccatgctgcacacaaatggaacaatgcagtgcttggtaaatgaacattcccgtaggagcggtattgcaatggcccaacattcaagccagtgggtgtggttccgcaagctttttgtaaccttgtccagttatacctatatgaacactcttagaaaggtaaagtaa

SEQ ID NO: 3791 - DNA, 882 bp, Glycine Max
atgttgacttcagcatcctcatcatcctccatcttctccttcacccctaaaaccctaaccatacccccacagcaacctcgcttcaccgtccgggcccactccaaaccccccattctccccaacctcaaaaccctcgccggcgccgcggtcttcgccgccgtcgcgctccaattcccctccaccgcacgtgcctcccctccgcctcctctcgaaaccgaccaccgcctcaacgtcgaggagtccctctcccctctctccgacctcctcgaaaccaacgccgaggccctcgccgcgctcaagtccctcctccagcagaagctcgagctcggcgaggacgacgaggcgctcgccatcctcaagcgcctcatcgccgcgcagcccgacgccgccgactggaagttcctcgcggcgcgcctcaccgcggagacaggcgactcggactccgcgcgcggctactacgaggaggtcctcgccgcgaacccgctctctttcgaggcgctcttcgagaacgcgctgctgatggaccggtgcggcgagggggaggccgcgatgcggcgcctcgaggaggcgctgcgagtggcggaggaggacaagatggcgaaggaggccagagacgtaaagctcatcatggcgcagatcatgtttcttcagaaaaacgtggatgaagcgttagtaatttataatcagctcacgaaagaggatcctagggatttcaggccttatttttgtagaggcatgatttatagcttgcttgataggaatgaagaagctaaggagcagtttgcaaaatacagggaattgagtccaaagaagtttgaggttgatgggtatttgagaacccctttgtcaaggatgaagctgtttagcactgatgagagttga

SEQ ID NO: 3792 - DNA, 486 bp, Glycine Max; identical to SEQ ID NO: 552

SEQ ID NO: 3793 - DNA, 243 bp, Glycine Max
atgttgagtgcgacggcgatcggcgcgttgttgggtttgggaacccagatgtactccaatgctctccgcaaactcccctacatgcgccatccgtgggagcacgtggtcggaatggggttgggagcggtatttgtgaaccagcttctcaaatgggaggcccaagtggagcaagacctcgacaagatgctcgaaaaggccaaagccgccaacgaaagacgttacatagatggagatgatgattaa

SEQ ID NO: 3794 - DNA, 276 bp, Glycine Max
atgttgagtgcgacggcgatcggcgcgttgttgggtttgggaacccagatgtactccaatgctctccgcaaactcccctacatgcgccatccgtgggagcacgtggtcggaatggggttgggagcggtatttgtgaaccagcttctcaaatgggaggcccaagtggagcaagacctcgacaagatgctcgaaaaggccaaagccgccaacgaaagacgttacataggttccccttttcttttcaatccaaactatgtaacgaaagacgctgcatag

SEQ ID NO: 3795 - DNA, 492 bp, Glycine Max
atgttgatgagcaagcagaagaagagccagatccagaacgcgaagaggttgttgataagcatcaatgtgctggggagcgcggggcccattagatttgtggtaaacgaggaggagcttgtggcggcggtgatagacaccgccctcaagtcctacgcccgtgaggggaggcttcccgtcctgggaaacaacaccaccggtttcgcgctttactgcccccatcttggatccgatggtaccttcactcctctctctttattaaattggattgccaaaattggttttttaaaaatctggattttcaaattactctgttgtggttgcaagattttttcagaattgaattcgacatattactctattgtggttgcaagatattttcagaaattgaattggacaaattattctcttgtggttgcaagatattttcggaaaagtgaattggaggaattactgtatcgtctggaatcatgggccatgctaatctctgtctag

SEQ ID NO: 3796 - DNA, 1266 bp, Glycine Max; identical to SEQ ID NO: 553

SEQ ID NO: 3797 - DNA, 2766 bp, Glycine Max
atgttggcgctcaagcctctcccctcagatctctccctccgcccatctccggcgaccctcgccatcaaccgccgccggaggatccagttcccagcctccgtgcggcgaagcgtggatgttaaagcggcggtcagcggcggagacaagagccagacgacatcgacgacgacgacgtctccttcgttggacagcaaagagaggaaagggaagagttcagtggcatcatctggctctggcattgatgaagaaggaatacaagtgaaggcagtggtgacaataaggaagaagatgaaggaaaatatcactgagaagcttggggatcagtgggagaacatggtcaacggcttcggtcaagggatccagattcaactcatcagcgaggaaattcaccctgttactaattctgggaaaagcgtgcaatcctacgtgagagggtggctaccgaagccgtcgaacgttgcttacattgtggaatactctgctgaattcagcgtaccaagtgactttggatgccccggtgctgttcttgtcaccaatcttcatggaaaagagttctacctagttgagatcatcgttcatggcttcagcggaggacccattttcttcccagcaaacacgtggattcattcgcgtaacgacaaccccgaaaccagaatcattttcaagaacaaagcatacttaccgtcgcaaacaccggctggcatcaaagatcttcgacgcgaggacttgctaagcataaggggtacccaacacgggcaaagaaagcaacatgatagaatctatgattatgctacgtacaatgacttgggcaaccctgataaggatgaggaacttgctaggccagtccttgggggtcacgaaatgccttaccctcgtcgttgtagaactggaagacctcccactctctctgatccactgtctgagagtagaattgaaaagcctcatcctgtttatgtgccacgggatgaaacttttgaggagatcaaacaggacactttctctgctggaaggttgaaagctctgttccacaatcttttgccatcgctcgcagccactctgtcgagttcagacgttcctttcaagtgcttctccgacattgacaagctttatatcgatggtgttgttctgagagatgaagagcaaaaaggggtaatggaaaatctcttagttggcaaggtgatgaaacaagtcctgagtgctggggagagtttgttgaagtatgagatccctgcggttataaaaggggataaattttgttggttgcgggacaatgaatttgcaagacagaccttagctggggtcaatccagtgaatattgagctgttgaaggaatttcccatccgcagcaagctagatccttctctctatggcccttctgaatcagcaataacaaaggaacttctagagcaagaacttggtggaatgaacttggaacaggctattgaggaaaagagactgtttatccttgattaccatgatatgcttttgccgttcatcaagaagatgaactctttgcctgggaggaaagcttatgcctctcggacaattctcttcaatacaaagactggtattttgcgccctatagcaattgagctttcacttcctcaaacgcactcttccccacaaaacaaacgaatttacacacaagggcatgatgccacaacacactggatttggaagttggcaaaagctcatgtatgctcaaatgatgctggcatccatcaactagtaaatcattggttgagaactcatgcatgcatggagccatatattattgctactcgtagacaactaagctcaatgcatccaatttacaagctgctacaccctcatatgcgctacacattagaaattaatgcactagctcggcaaaatctgataaatggaggtggtataattgaggcatctttcagtccaggaaagtatgccatggagcttagttcagcagcttacaagaaattgtggcgatttgacatggagtcactgccagcagatcttattcggaggggcatggcagtagatgacccttcaatgccctgtggtgtaaaacttgtgattgatgactacccttatgctgcagatggactcttgatctggtcagccataaaagaatgggtagaatcttatgtagcacacttctactccgatccaaattcagtcacatctgatgttgagctccaagcatggtggagagaaatcaagttaaagggtcactctgacaaaaaaaatgaaccttggtggcctaaactcgataccaaagaggacctatccggtatacttaccacaatgatatggattgcttcaggccaacatgctgccataaactttggacaatacccctttggaggatatgtgcctaaccgccctaccctcatgagaaaactcatccctcaggagaatgatccagattatgagaagtttattcaaaatcctcagcttgttttcctatcatcactacctactcaacttcaagctaccaaagttatggctgttcaggacacactgtccactcattcacctgatgaagagtacttgggtcaacttaaacctctgcagaatcattggatcaatgatcatgaaatcatggaattatttaataaattttctgctagactggaggaaatagaggaaataataaatgcaagaaacaaggacccccgtttgagaaacagaagtggtgctggtgtccctccctatgaactgttgcttccctcgtcagggccaggggtaaccggtcgtggaattcccaacagcatatctatatga

SEQ ID NO: 3798 - DNA, 1398 bp, Glycine Max; identical to SEQ ID NO: 554

SEQ ID NO: 3799 - DNA, 113 bp, Glycine Max
atgttgtgctacatgtttcatgttctcagtctcaaatgtttctttctttcttggtgtagttttcagtttttgacgattttgtatcctcacgcatttgtatctctcctttcctt

SEQ ID NO: 3800 - DNA, 2100 bp, Glycine Max
atgttgttatccattttcttcatcttcattatcccttgtgctttccctctatcctttaacatcactagtttcgatccaaatggcaagagcataatatatgagggatcagccaaccctgtaacaccagttatcgaactcacaggaaacgtacgggacatcacaggtagagccacatatttccaacctatgcacctgtgggacaaagccacagggaatctcacagatttcactacccatttctcctttgtcatagattcacggaaccaaagtgcatatgaagatgggatggcattcttccttgcccctgctggtttaaagtttccttatgtctccagaggaggtgctttgggtctgacacttgaggaccaacgattaaactccactgacccatttgttgctgtggagtttgatatctatgagaatcccgatgatccacccggtgaacatgttggaatcgacatcaactctttgagatctgttgctaatgtaacatggttggctgatatcaagcaagggaaactcaatgaggtttggatcagttacaattctagttcatttaatttaagtgttgtgttcacgggttttaacaatgacaccattctgcggcaacatctatctgctataactgatctgagacttcatttaccagaatttgttactgttggcttctcagctgccacgggaattgatactgctatacatagtgtcaattcatgggattttagttcaactttggcagcacaagaaaacataacaaagggagcagacacggttgccagtcagaagaaaaagaataagaccggcttggcagtgggattgagtattggtggatttgttttgattggtgggttgggtttgatttcaattggcttgtggaagaagtggaagaaaggaagtgtagaggaagatcttgtttttgaagagtatatgggagaagattttggaaggggggcaggacccaggaagtattcatatgctgaattaacagaggcagctaatggtttcaaagatgagcacaagctaggacagggaggatttggaggtgtttataagggttatcttaaagacataaagtctcatgtagctattaagagggtgtcagaaggctctgatcaagggataaaggagtttgcttcagaagtaaacattattagccggttaaggcatcgaaatctagtgcacttgatcggttggtgtcatgcagggaaaaagctcttacttgtgtatgagtacatgccaaatggaagcttagatattcatcttttcaagaagcaaagtttgttgaaatggacggtgagatataacatagctcgaggattggcctccgcattgctatacttgcacgaggaatgggaacaatgtgttgtgcacagagacataaagtcaagcaacattatgctggattcagagtttaatgccaaacttggggattttggcttagcaaggtttgtggaccatgcaaaaagtgcacaaactacagctttagctgggactatgggctacatggctcctgaatgtgctacctcgggcagggctagtaaggagtcagatgtctacagtttcggagttgttgctttagagatagcttgtggaagaaaacccataaaccatagggctcaagaaaatgaaataaatattgtggaatgggtgtggggactctatggagaagggagaattcttgaagcagcagatcaaagactagaaggggaatttgaggaggagcaaataaaatgcttgatgattgttggtctttggtgtgctcaccctgaccataacaataggccttcaatgaggcaagcgattcaagtgcttaactttgaagctcccttgcctaatcttccatcaagtttgcctgttcctacatatcttgaaggccccttgcactcattcatagcaccattcagcataacttcttcggaggaaggtcaaagccagatcacaggctccagttccaacacaaactccaccgggataaacttcttgcatttatttgattttgtcaaatctttaaaagaagaaaacaaagacaatgtaatcaacaaactagaacctcctcagtccacacattatgttaacctcagctggtcacaacaacaataa

SEQ ID NO: 3801 - DNA, 1123 bp, Glycine Max
atgttgttatccattttcttcctcttgattatcccatatgcttccgctttgtcctttaacttcactagttttgatcctaatgacaagagcataatatatgaaggatcagcaaaccctgtagcaccaactatccaactcacaagaaaccaaatggacaaaaacatgattggaagcataggtagagccacatattgccaacctatgcacctgtgggacaaagccacagggaatctgacagatttcactatccatttctccttcgtcatagattcacgtaaccgaagtaaatatggagatgggatggcattcttccttgcccctgctggtttaaagattcctaatgccactaaaggaggttctttgggtctgacacttgataaccaacgattaaactccactgacaatccatttgttgctgtggagtttgatatctataagaatccctatgatccacccggtgaacatgttggaatcgacatcaactctttgagatctgttgctaatgtaacatggttggctgatatcaaggaagtaaaactcaacgaggcttggatcagttacaactctagttcgttaaatttgagtgttgtgctcaatgtttttaacaatgatactgatcataccattcagcagcaatatctatctgccaaagttgatcggagactttatttaccagaattggttacttttggcttctcagctgccacgggaaatgcaactgctatacatacacaagaaaacataacaaagggagcagacacagttgcaaggtctccagcaacctccaatatagctcccagtcagaagaaaatgaataagaacggcttggcagtgggattgagtattggtggatttgttttgattggtgggttgggagaaatgcatgataaaaacaataatcttgaactcatttactattggattatcttttttcttttttcgcagaaatctaaaactgtctcagtaaaactaagatttcaaactcttcaaccgttggattgtcgtgaaattttgatatgtgattcaagtaataagaagaaaaacttgagaaatctcaaaaaagtactagagatactactagtgctgccagaacacttgaaattgatgatgcttctccttctgt

SEQ ID NO: 3802 - DNA, 4725 bp, Glycine Max; identical to SEQ ID NO: 555

SEQ ID NO: 3803 - DNA, 159 bp, Glycine Max
atgtttagggtacaaattatattttatttaccaaaaagaggaaatgaccttcaaactatcatattatcagtaacttatcttgcattcttgctagggaattggaaacttaagttacaactaacaaaatttggtccttcccctaaaaaacagggtccttaa

SEQ ID NO: 3804 - DNA, 3165 bp, Glycine Max
atgtttcaaatcacatcagaaccacctaacaggccaccaagtggttccctttttctatttgatcggaaggttttaaggtactttagaaaagatggacataattggagaaagaaaaaagatggaaagactgtgaaggaagcacatgaaaagtgggaagtgttgatgtgttacactgctactatgcccatggagaagaaaatgaaaattttcagaggcgaagctattggatgcttgaactgtgaggatatgatgcatatagtatttgtccactacttggatgttaaggtgttttctgggttcttcgtctttcaggttaacaaaaccaatattggtggaaaaacatattctgatgaggttacatcagattcccagaagagcagttcttttatgccttcaggaagtacagattccatgagcccaacgagcactttgacatctttatgtgaagatgctgattcagaggatattcatcaagcaagttcaggattacactcctatcgtgaatcacaaaatttggggaatgatcgtccgatggataagattcatgctcgttcaaatagttcctatcttatgcatccattttcagataatcatgggcagttaccagtttctggagcagaatatatcccacatgttcaggggaataagtctagagctagtgatactacttacattgagggtcagagagcacatggcattgcatcctgggacaatgccatggaacagtctgcaggaaagcatgctgatccttctcttgtatcatctacgtccattccatcaagtgcaatgggaaacatacttgacaaaaaccatactgttccaggcaaccttttagggcataaaattgccctcactgaagtggaaaggggcgctcagcctgtccaatcaaactggcaggttctcttaggaacagttgtgctatcttgttggatgggacaatttatggaattttctgtcccagaaaccatagtttctgcaattgtggtggagcggcaccctgctcctcctccaagggcagtcatggtgtggtgtgcattttttcccggggagggggggggggggggttctctgcgctattacccgctactgactactatgctaattccttttgaagacaatactggagaattgcctaattggggctttacccaatcattgggtttggaatttggatctgattatgcaagtatcaattatgccttgaccatgaggcgtggattattggatggagaggagagcctcaagaaggttgatagtttctctaggtggatgaccaaagaacttgcaggtgtggatgatctgcatatgcagtcttcccctggtatttcatggagcacagatgaatgtggggatgtgatagatgatacatcattgcacctgtccctgtctcaagaccagctgtttagcataaacgatttttcacctaaatgggcttatgctgaatcagaaattgaggtgttgattgttggaacatttttaaagagtcaacctgtggtggcaaaatgtaactggtcctgtatgtttggggaagtggaggttcccgctgaggttttagctgatggaattttgtgctgtcaagctccacctcataagattggacgggttcccttctatgtaacatgttccaataggtttgcttgtagtgaagttcgggaatttgagtacagagagggcttcgatagaaatataaattttccagatttttttaacaattcaagtgaaatggagcttcatttgcgactggtggggttactttcgttaaactcaatgcacactttaaatcaagtgtttgagggtgatatggataaaagaaacttaatattcaagcttatttcactgaaagaggaagaggaatattcaagtaaggaagagacaactgcagagatggatatatcacaacagaagttgaaggagcatatgtttcacaagcaggttaaggagaagttgtactcatggcttcttcacaaagttactgaaactggtaaagggcctcttgtattagatgaagaggggcaaggcgtgttacacttaattgctgctcttggttatgattgggctataaatcctatcataactgctggagtcaatatcaacttccgtgacgtgaatggatggacagctctacactgggctgcattctgtggccgagagcgaacagttgctgtccttgtctccatggatgcagccgctggtgcattgacagatccatgtcccgaatttcctttgggtagaacacctgcagatcttgcttctagcaaaggccacaaaggaatttctggttttcttgctgagtcattattaactagccacctcgaatcactcacaatggatgaaaataaagatggtaggaaagaaacttcaggaatgaaagtagtgcagacagtttcagagcgaactgcgacacctgtgcttaatggtgatatacctgatgatatctgccttaaggattctcttaatgctgtccgtaatgctacacaagctgctgatcgtatatatcaagtattcagaatgcagtcatttcagaggaagcagttagctctgtatgaagatgatgaatttggattgtcagatcaacaagctctttctctcctagcttctaaggcgtgcagatctggtcaaggagagggtttagccaatgctgctgcaatacaaatacagaaaaagtttcgtggttggacgaagagaaaagaattcttgattattcgccaaagaattgttaaaatccaggcccatgtaagaggtcaccaggtcaggaagcagtataaaccaatcatttggtctgtgggaatcctggaaaaggttatattacgctggagacgcaagggcagtggtttacgtggatttcgaccagcttcccagaacaaggtccccgaacaaccaagcgaatctccgaaagaggatgactatgattacctcaaggaaggaaggaaacaaagtgaagtgaagttcaaaaaggccctttcacgggtgaagtccatggttcagtatccagaggcacgggctcaatatcggcgggtgctaaatgtagttgaggacttccgtcaaaccaagggaggtaatttgaatttgataaattcggaagagacagtcgacggtgtggaggatttgattgatattgacatgcttttagatgatgaaaatttcttacctatagctttcgattga

SEQ ID NO: 3805 - DNA, 2334 bp, Glycine Max
atgtttcggagactcagatggtttgtgggtctaaatcagaagaattggtcaaccaaaaggttggtcaatgttgatcatcaacctggccctggaacgccaaataagttgttgcctgtgcttgatgctgtgcatgaggttgcaatttacattcataggttccataatcttgacctttttgaacaaggatggtacaaaatcaaggttaccatgagatgggaggatggtgaaggctcctatcccgggattccggcgcgggttgttcagtatgaagctcctgaagtgggttctgacaatttatgtagagtctggatgattgatgatacagacaacagtttttcaacaccacctttccatattaaatatgcaagacaggatgtgtttctttctatcatgatctcattctacctgtcttttggtgaatgtgagggacaatcctctgctgttatcttgaagtttgaactcatgcatgctcctataattgaaactgggcctgagttactaggttcactggatgcatatgctgcttcagttcatgaatataaaatcccccctaaagctctccagggattacattcatattgtcctgttcattttgatgctttccatgctgtccttgttgaaacaagcattcacatcagtctactaaaagctagttatcacacatctcgacagaaggttcagaaggtgcttatgttgaagattatgttgggtcaaacaaggtatgaaatctctttgcttactattgtaacttattcttctgattgtcaaaactcaaatcaggttatgctcatcaaagcattgatggctgcatatgatatcctgcttgaagatttgagaagaataagcacaggcattggcaaagctattgatttgactgaaatgacttctgaatcagatgctacagaattgtttgcttctactcctccagcatgcgtgaaaagtattgatgttcaatcatctcttcaactcttcatttctttaggaaatcagctcttatgtctctggaatatatttctaaaattccacagggaaaacaaaacaaaaatactggaatttctacgtaaatcctgggagattgataggagaactgaatggtcaatatggatggtgtactcaaaggttgcaatgcctcgtcaaaatatgagcaatggagttgaggggacatcattgtcccatggcatgcatagaagttcaataattacaaggaggtttactgatgatcctattcaaactgcagcaatgcgtgcagaacttcacaggcgaggaatagctcaaatgaggatcaacaatcggtcacttcaagatatgtatatatttggagatcctctgctggttcctattattattgtagaacgcttgacaaacgtgtaccattctgccattgtgaactcaaacttcattcctttggagggtgaagggaggcatatcctagaaaatggatccagagccacaaagaagttgtgtggtagtagtccacagaaaaatgaacttgttttgagaatagttgtttttgttcatggatttcagggaaatcatttggatttacggcttgttcggaaccaatggctcttaatagaccccaagatacagtttctaatgtcacaggcaaatgaagataaaacatctggagacttcagagaaatgggatttcggcttgcccaggaagtgatcttgttcctgaaaaagaagatggataaagcttcaagaaatggaaacttgaaagatatcaagcttagctttgttggtcattctattgggaatctcattatcaggacagccttgacagagagcgtcatggagccatatctaagatacttacatacatatgtctccatatcgggtccacacttgggttatatgtatagttcaaactctctattcaattcagggttgtggatattgaagaagctcaagggcacacaatgcattcaccaacttaccttcacagatgaccctgatcttgagaatactttcatctacaatctttccaaggagaagacactggctaacttccagaatgtgcttcttttgtcctcacctcaggatggctatgttccataccattctgcgagaatagaaccatgtccagcagcttctttggatttctctaaaagagggaaaatcttcctggagatgctgaataattgcttggaccaaatccaagctcacactaacgatagggtggtcatgcgctgcgacatcaacttcaacacctcttcctatggcaggaacttaaacacacttattggacgaacagctcatattgacttcttggaatctgacatttttgcaaagttcataatgtggtctttcccagatctgtttagacagtaa

SEQ ID NO: 3806 - DNA, 2283 bp, Glycine Max
atgtttcggagactcagatggtttgtgggtctaaatcagaagaattggtcaaccaaaaggttggtcaatgttgatcatcaacctggccctggaacgccaaataagttgttgcctgtgcttgatgctgtgcatgaggttgcaatttacattcataggttccataatcttgacctttttgaacaaggatggtacaaaatcaaggttaccatgagatgggaggatggtgaaggctcctatcccgggattccggcgcgggttgttcagtatgaagctcctgaagtgggttctgacaatttatgtagagtctggatgattgatgatacagacaacagtttttcaacaccacctttccatattaaatatgcaagacaggatgtgtttctttctatcatgatctcattctacctgtcttttggtgaatgtgagggacaatcctctgctgttatcttgaagtttgaactcatgcatgctcctataattgaaactgggcctgagttactaggttcactggatgcatatgctgcttcagttcatgaatataaaatcccccctaaagctctccagggattacattcatattgtcctgttcattttgatgctttccatgctgtccttgttgaaacaagcattcacatcagtctactaaaagctagttatcacacatctcgacagaaggttcagaaggtgcttatgttgaagattatgttgggtcaaacaaggtatgaaatctctttgcttactattgtaacttattcttctgattgtcaaaactcaaatcaggttatgctcatcaaagcattgatggctgcatatgatatcctgcttgaagatttgagaagaataagcacaggcattggcaaagctattgatttgactgaaatgacttctgaatcagatgctacagaattgtttgcttctactcctccagcatgcgtgaaaagtattgatgttcaatcatctcttcaactcttcatttctttaggaaatcagctcttatgtctctggaatatatttctaaaattccacagggaaaacaaaacaaaaatactggaatttctacgtaaatcctgggagattgataggagaactgaatggtcaatatggatggtgtactcaaaggttgcaatgcctcgtcaaaatatgagcaatggagttgaggggacatcattgtcccatggcatgcatagaagttcaataattacaaggaggtttactgatgatcctattcaaactgcagcaatgcgtgcagaacttcacaggcgaggaatagctcaaatgaggatcaacaatcggtcacttcaagatatgtatatatttggagatcctctgctggttcctattattattgtagaacgcttgacaaacgtgtaccattctgccattgtgaactcaaacttcattcctttggagggtgaagggaggcatatcctagaaaatggatccagagccacaaagaagttgtgtggtagtagtccacagaaaaatgaacttgttttgagaatagttgtttttgttcatggatttcagggaaatcatttggatttacggcttgttcggaaccaatggctcttaatagaccccaagatacagtttctaatgtcacaggcaaatgaagataaaacatctggagacttcagagaaatgggatttcggcttgcccaggaagtgatcttgttcctgaaaaagaagatggataaagcttcaagaaatggaaacttgaaagatatcaagcttagctttgttggtcattctattgggaatctcattatcaggacagccttgacagagagcgtcatggagccatatctaagatacttacatacatatgtctccatatcgggtccacacttgggttatatgtatagttcaaactctctattcaattcagggttgtggatattgaagaagctcaagggcacacaatgcattcaccaacttaccttcacagatgaccctgatcttgagaatactttcatctacaatctttccaaggatggctatgttccataccattctgcgagaatagaaccatgtccagcagcttctttggatttctctaaaagagggaaaatcttcctggagatgctgaataattgcttggaccaaatccaagctcacactaacgatagggtggtcatgcgctgcgacatcaacttcaacacctcttcctatggcaggaacttaaacacacttattggacgaacagctcatattgacttcttggaatctgacatttttgcaaagttcataatgtggtctttcccagatctgtttagacagtaa

SEQ ID NO: 3807 - DNA, 2232 bp, Glycine Max
atgtttcggagactcagatggtttgtgggtctaaatcagaagaattggtcaaccaaaaggttggtcaatgttgatcatcaacctggccctggaacgccaaataagttgttgcctgtgcttgatgctgtgcatgaggttgcaatttacattcataggttccataatcttgacctttttgaacaaggatggtacaaaatcaaggttaccatgagatgggaggatggtgaaggctcctatcccgggattccggcgcgggttgttcagtatgaagctcctgaagtgggttctgacaatttatgtagagtctggatgattgatgatacagacaacagtttttcaacaccacctttccatattaaatatgcaagacaggatgtgtttctttctatcatgatctcattctacctgtcttttggtgaatgtgagggacaatcctctgctgttatcttgaagtttgaactcatgcatgctcctataattgaaactgggcctgagttactaggttcactggatgcatatgctgcttcagttcatgaatataaaatcccccctaaagctctccagggattacattcatattgtcctgttcattttgatgctttccatgctgtccttgttgaaacaagcattcacatcagtctactaaaagctagttatcacacatctcgacagaaggttcagaaggtgcttatgttgaagattatgttgggtcaaacaaggtatgaaatctctttgcttactattgtaacttattcttctgattgtcaaaactcaaatcaggttatgctcatcaaagcattgatggctgcatatgatatcctgcttgaagatttgagaagaataagcacaggcattggcaaagctattgatttgactgaaatgacttctgaatcagatgctacagaattgtttgcttctactcctccagcatgcgtgaaaagtattgatgttcaatcatctcttcaactcttcatttctttaggaaatcagctcttatgtctctggaatatatttctaaaattccacagggaaaacaaaacaaaaatactggaatttctacgtaaatcctgggagattgataggagaactgaatggtcaatatggatggtgtactcaaaggttgcaatgcctcgtcaaaatatgagcaatggagttgaggggacatcattgtcccatggcatgcatagaagttcaataattacaaggaggtttactgatgatcctattcaaactgcagcaatgcgtgcagaacttcacaggcgaggaatagctcaaatgaggatcaacaatcggtcacttcaagatatgtatatatttggagatcctctgctggttcctattattattgtagaacgcttgacaaacgtgtaccattctgccattgtgaactcaaacttcattcctttggagggtgaagggaggcatatcctagaaaatggatccagagccacaaagaagttgtgtggtagtagtccacagaaaaatgaacttgttttgagaatagttgtttttgttcatggatttcagggaaatcatttggatttacggcttgttcggaaccaatggctcttaatagaccccaagatacagtttctaatgtcacaggcaaatgaagataaaacatctggagacttcagagaaatgggatttcggcttgcccaggaagtgatcttgttcctgaaaaagaagatggataaagcttcaagaaatggaaacttgaaagatatcaagcttagctttgttggtcattctattgggaatctcattatcaggacagccttgacagggttgtggatattgaagaagctcaagggcacacaatgcattcaccaacttaccttcacagatgaccctgatcttgagaatactttcatctacaatctttccaaggagaagacactggctaacttccagaatgtgcttcttttgtcctcacctcaggatggctatgttccataccattctgcgagaatagaaccatgtccagcagcttctttggatttctctaaaagagggaaaatcttcctggagatgctgaataattgcttggaccaaatccaagctcacactaacgatagggtggtcatgcgctgcgacatcaacttcaacacctcttcctatggcaggaacttaaacacacttattggacgaacagctcatattgacttcttggaatctgacatttttgcaaagttcataatgtggtctttcccagatctgtttagacagtaa

SEQ ID NO: 3808 - DNA, 1890 bp, Glycine Max; identical to SEQ ID NO: 556

SEQ ID NO: 3809 - DNA, 531 bp, Glycine Max
atgtttttccacatagtactggagcgaaatatgcagcttcatccacgctactttggtcgtaaccttcgcgataatctcgtttccaagcttatgaaagacgtggaaggcacttgcagtggccgacatggatttgtggtggcagttacagggatagagaacatagggaaagggctaattcgtgatggaacagggtttgtgacatttccagttaagtaccaatgtgttgtcttcagaccgtttaagggagagatcttggaagcagttgttactatggtgaacaagatgggattttttgctgaagctggacctgtccaaatctttgtttcaaaccatttgattccggatgatatggagttccagtctggagacatgccaaattacactacatcagatggatcagttaagattcaaaaagatagtgaagtgagactaaagataattgggactcgagtggatgctacagaaattttctgcataggtaccataaaagatgatttcttgggtgtgatcaacgaccctgcaacagtttaa

SEQ ID NO: 3810 - DNA, 222 bp, Glycine Max
attattagacgagcatcattttctgcaaccaaagcaactcacaagggactcggagtcccaaaaggccatcttgcagtctatgttggagacaagataaggcggtttgtgattcatgcattgtacttgaaccaaccctcattacaagaattattaagtggtctcacaattccatgtcaagaggatgagttcctaagcgttccctcttgcttgaataagttgtaa

SEQ ID NO: 3811 - DNA, 579 bp, Glycine Max
attgactatttacaaagggcacagtggcttcgtgcagcggttttaggagccaatgatgggttggtttcggttacatcattaatgatgggtgtaggagctgttaagagagatgaaaaggctatgctacttgctggttttgcaggattagttgcaggaacttgtggcatggcaataggagagtttgttgctgtgtgcactcagtatgaagttgagctaggtcaaatgaagagagacatgaacatgactgtgggagaggagaaagacttggagatggggatggagaaaagagcattgcctaatccattgcaagctactttggcatctgcagtgtccttttcaattggtgcattggtgcctctactttcagctgctttcatagaaaactacaggaatagggttattgtggttgtggcaatggctagtttggctttggtggtttttggaagggtggtggctcagctgggaaaaactcataagatgaaatcttgtgtgaggttccttcttggaggatggatagccatggctattacttttgggttgaccaaattacttggtgctaaagctttagataatgaataa

SEQ ID NO: 3812 - DNA, 960 bp, Glycine Max; identical to SEQ ID NO: 557

SEQ ID NO: 3813 - DNA, 1014 bp, Glycine Max
atttcaccggcaacctcaatagaatttcatgcaggggagggtcagaagatgaatgacatttgtcttcatctttttttgccaacaacaacatttctgccaattgattatctctgtctcaaactcgaacacagttgcactgatactgttctactccatatacacgccaatgcctctacttttaataggtgcatcaaaatttattctcatggtggaatttggttgctgtcgcgtttgttgattttgcgacaaatcacggaaaaatgtggacaattccacttgtcaccatatgccgctggcgcaaggaattccaagacaccacatctctgtcacacatttcatcaaaaacttcatgtgcactatcaatattgtctctctttgcatacatgcatggaaatcaattctcttgttaccatgtatgcaaagagaggcaatatagatagtgcacatgaagttttcaagagcattagtggtattcgaggggatgcagaaacaaaatttggagatgaatgctataacatttaccggtgtcatttctgcaggcactcatgctggcctagtcgacaaagctcaacactacttcaatggaatgatcaatgcaatatagagcttggaaaacttgctgctgaaaaaattatttcacttgagccacaaaactcagaagcatgtcacattatccaatatgtatgctgcagcaggaaactgcatgatagaaaggtgaaaaaagcacatgggtacagttggattgaggtgaaacacaagcatacacattctttgccggcgattcgtcacatcctaaagaggctggttatcagcctgatacaaaaagaaactattctttctcatcatagtgaaaggcttgctattgcctttggtgtctgtggagattgccacaactttatcaagttagtgtcactaattgaacagggacatattgttgtaagagataaaaacggtttcaccactttaaaggtggtttgtgctcatgtggggactactggttatgttttgggctaa

SEQ ID NO: 3814 - DNA, 254 bp, Glycine Max; identical to SEQ ID NO: 558

SEQ ID NO: 3815 - DNA, 180 bp, Glycine Max
caaaaccagaaagtgccacgtcatctgcaatcgccggccggcgagggcttaactcctccgaactcatcgcagacgacgaattctctttcgaaagtgaccttgaccggtctctcgatctccggtcatcgtccgacccgaatatgtcgctgtaaaatccctcattcctcgccggaatcctga

SEQ ID NO: 3816 - DNA, 146 bp, Glycine Max
caagtttgtctatacggcaccaatctcgccatcatcaaaaccctctccaattatggcatcaaaatcgtcatcggcccctttaacgatgacatttcaagtctcgttgtagatctcaatgcggccactcagtgggtgaatgcgaatgt

SEQ ID NO: 3817 - DNA, 282 bp, Glycine Max
caatctatactccttaattcttacaatttattatctttctctaagaactcttccaattttttctctctcttcctctttagcttcatcgccatggcatcaccagcaagaaccttctttgccttcattctcgccgtcgtcgctctcttcttcgccgccgccaatgctcaagacctctccccggctccgagtcccgatgccggagcggcgggatccgtttcgagctccgtcgccatgatcggagcttcggttgtgctgtcattgatggctatcttgaagcattga

SEQ ID NO: 3818 - DNA, 111 bp, Glycine Max
cacgcgatggatgaagattttagatttcatgttttttattatgctcttaattttattgtggatgctgcaagagttgatatagctcggatttgtttttctagaggcttttag

SEQ ID NO: 3819 - DNA, 346 bp, Glycine Max
cactctcctcctgaatctcaacctcatttgaccccaaaaaccccaccaacaaatgaaccacgtcaccaacatcaacaatcaccttcacgtacttctcatcctccaccacaacttccagaagattcttcagcgcttgtcgcttcatacccaaatccccaaccttcatcctcgtcgttaagtccctcacatcgtggcactccgtcgcggtggccaccaccgccgcagccagccgcgagagggacgggctctcgccggagtcgcatttctcggcggcgattaggccggcgtgaagctcctccaacttggcccgaatcagctgccattttccggagaagacgcgaatcgg

SEQ ID NO: 3820 - DNA, 1215 bp, Glycine Max
cagataggtggtcgtgcagatcatcctcatctgattcgtgttcttcatcttgctcgaaatggggtttatctaagagatgtaaagagatggcttggggaattgagaggaaaagacttgccagatgctttttcttggtcctacaagaggaggtacaagagtggatatgtgtggcaagacttgttggatgacgacctcataacccccatctctgacaatgaatacgtcctcaaaggatcacaaatccaccctaccccatttgcaacaactccttcacttgatgaaaagaaaactactgtttgtgatatccatgctgagaagaaatgtagtcaagtacaaactatagaggacaaaaaccagcagccgcctctagcagaagaagaacctcgaattcaacgagacttggatttgaaaacggatactccgacaaaagggtcatcagaaatcagccaggactcatcattggtcttcagctcagacaggtcatctgtgacagatgatgactcttcaaaggtcgaagaagagaagcatttagaggcaacaggcaaagacggcttcaacgaaatcaaccaagacaagttagaggattgctcattgccttccttgtatcacaatctgttgagtaagaaggctagccacaaagatgacctgaataaaaccaactcacctgattcatcctcctccactatatcatcatcttcatctcaatcctcctttactaagatcaggagcaattctgccagagtttctaatgtgttccgcaattggatcacttgtggcactgtggaaacaaatgatgcagccctggtccaaatgaacctggctcaaaagaatttatctaaggaacctatcaacatacctgaaagaagggctgagatttgtaagggagacaaattgggaggatcagccaggtgttttgcgacttcttggggtcatcatcaccagaaacaacaatatggggcaagaaaaagctttgatggaaatgaaactagcaggagcaggaaaaagttaggggagttgctaaatcaaacttcttccaaaccatttggtggaccaacctgctcgcaatgcgggaagtcgtttaagcctgagaaaatgcacaaacacatgaagtcttgtaaaggaatgaaagccttgggaaagtcctccacaactgttgaggaggcacagcttcagggatcatcagcttcttatacagattactttttgaccaactaa

SEQ ID NO: 3821 - DNA, 390 bp, Glycine Max
cagtttctccatctaccactattcaattctctatatttaacctctttccctcattctcttctttcactttcacttcctcatggcatcaacaaagagcatgttcatgtccttcgccatcctcctcctcctcgctctcttctccgccaccgtgtccgctcagggctctccaacaccggctccggatgccggagcagctggatcagtctcgagctctgcctccgtcatcggtgctgcggttgtgttgtccatgcttgccatcttcaagcactgagtgatccattcatacgtgttattgtggttttgtttacaaaactggtccgtttctatatacagctttaccgagtgatgtttatcgtgagttttgtgtttgtatatagtgtatactggtga

SEQ ID NO: 3822 - DNA, 147 bp, Glycine Max; identical to SEQ ID NO: 559

SEQ ID NO: 3823 - DNA, 162 bp, Glycine Max
cattatcatactcccccgtatttaatagtacttatttcatcaaagaacaggtcgcatcacacttcaaaaacacgaacactcaccttttcacaagacaataataataataaaaaaaaaactaaactacagattacatccagattctctttcgaacaaagctaa

SEQ ID NO: 3824 - DNA, 750 bp, Glycine Max; identical to SEQ ID NO: 560

SEQ ID NO: 3825 - DNA, 588 bp, Glycine Max
ccaaaacaaggtgaagagagcaacatagactactctcaaagggctcagtggcttcgagccgcggtgttgggagccaatgatgggttagtctctgttgcctcactgatgatgggtgttggagctgttaagaaagacatcagtgcaatgattcttgctggttttgcaggactagttgctggggcttgtagcatggcaattggagagtttgtctctgtgtacactcagtatgacatagagaaggctcagctcaaaagagagagtgagtcaaacaacaatagaggagtgaatgaagaagctcaaagggagaagcttccaaaaccatttcaggctgcactagcatcagcactggcattttctgttggtgctttggtgccaatgctagcagctgtgtttataaggagtcacaaggttagaatgggagttgttgctgctgctgttagcttggcattgttggtgtttggaggggtaggagcagttcttggaaacactccagtgaagaggtcttgtcttagggttcttattggaggttggatggcaatggccataacatttggtctcaccaaattgattggctctgctgaactctga

SEQ ID NO: 3826 - DNA, 699 bp, Glycine Max
cccattccatctgatatatccacattacttacttttgctagcaccatagatctctcatttaacaaatttaatggggaaattccagcaactttaggtaactgcacatacccgaatactcttaaacttgatgacaacatgttaagtggtgatatcccacaacaacttgggcagctttctaggattagaaaaatttattttgccaacaataatttatcatggccggttccactgttcccccttggcttagcttgtgttgattacacgaataatagtgaactttgtataggacaatgttcaaggaaggaagacatcaactcaatctcataccgcacacgaattgcaacctccacacttgcaagagaaagctttcaaagaggtactctttatttgtgcctcccatctcttgattcaattttctttcgttttcaagattcttgtaatcattggtgcttcttcctatcactgtgcctagtgagagagagcaaagagaaagaaaaaaatacaaagagagagaaaaatacatctaacttttctccttttctccttttctcatcatctcatgacattattatactacttgcattgaatatttcggtagtaacagagagaatgaagtccacaatgaagttcaacaaagtcagagatgcaactgattgcttttccatagacaatgccatttggaataatgtacaagggaag

SEQ ID NO: 3827 - DNA, 690 bp, Glycine Max; identical to SEQ ID NO: 561

SEQ ID NO: 3828 - DNA, 1599 bp, Glycine Max; identical to SEQ ID NO: 562

SEQ ID NO: 3829 - DNA, 518 bp, Glycine Max
cctcctcagtcactaaggccatcataccatatatatggctcaaagatagctgtgctatgtcgaattcgctatcatggaaagagttacagactaaaaggctccgtgaatgatgtaaaatgcatgaaatacttcctgattaaggagtttgggtttcttagtgactccattctcatgctcacagatgatagagacgagagaaaccagttaagaaccccaacgaaatataacattcaaatgaccatgagatggctgattgagggtagccaatcaggggattcaatggtgttccacttctcaggacatggcacactggaaatgaatatgtatggggatgagattgatgggtttgacgaagcaatatgtcctgttgattatgaagagcagggaaagatactcgatgatgagattaatgctgcaattgttaggccactaccacgaggtgctaaattccatgcctttattgatgcatgccatagtgggactgttcttggtttagcttttgtgtgcaagatgaatag

SEQ ID NO: 3830 - DNA, 2007 bp, Glycine Max; identical to SEQ ID NO: 563

SEQ ID NO: 3831 - DNA, 639 bp, Glycine Max; identical to SEQ ID NO: 564

SEQ ID NO: 3832 - DNA, 593 bp, Glycine Max
cctggggttactgcaggtaagactgctgaaatggaagtagttgctgtaccatcacttccaaaacagttgcatctctatactgcagcagatgaggtgatcaattccctacttgatttgcgacttgaaaagtggggtctgcctccatttgaagattgggtggagggaactttgcccctagatccttggtatattgttggtcctgtcgttaagggatttggtcgtgactcgaaggtacttgggatccctacagcaaatttatcaacaaagggctattcagatctcctttcagagcatcctgcgggagtttattttgattgggctggattgtcagccagaggtgtttttaaaatggtgatgagcattggttggaatccttatttcaacaacaaagagaagactatagaaccatggttacttcatgacttcaacgaagatttctatggagaagaactgcggcttgttatagttggttacatacgtcccgaggccaattttccatcccttgaaagcttggtagctaaaattcatgaagatcgaagagttgctgagagggcccttgatcttcccttgtattcaagttttaagaatgattc

SEQ ID NO: 3833 - DNA, 303 bp, Glycine Max
ccttcagtgggggatggaacagtgcttggtgggcctggggtgatgccacccggtgggcccattgaggagtcaggtgggcttggaataatgatgggaggattgagtacgggctcaggagagcctggcgtgatcccgggtgggcccattgaggagtcaggtggacttggaataatgatgggagggttgagcacgggctctggtgagcccggggtgatgctgggttggcctggaacgggttccggagttggtgtggggaaggactctggtgggccaggtgttatggttgttgggcttggtggtgag

SEQ ID NO: 3834 - DNA, 1296 bp, Glycine Max
cgacgtaagttgcttgatcagtccagtaaccttgcagctgaacatttcagtggtgggcctgctatagagatcagttctattccaattgcccagagcagtggagctttcccagctgtgccagacaccaataagaaacaaaatcagtcacctgcaccattgccttcaccttctgtttctccacatgtgaatcaagcaagtcaacaaaattcacctaatggtgcatctggaaaattatggaagtatatcattataatcacaggtgttgctgtcttggtcattcttgttgtgatcatgctttgcatttggcgaaaacgagcagcaaaagtaataaagccctggaagacaggaataagtggacagttgcagaaagcatttataacaggggtccccaagttgaatcggggagagctggaaacagcctgtgaagatttcagcaatattattaatagttttgatgaatgcaccgtatacaaaggaacactatccagtggagtcgagattgctgtcgattcaactattgttgcttctgccaatgattggtcaaagaacatggagacagcctatcgcaaaaagattgctgcattgtcccgtgttaaccataagaactttaccaatcttattgggtattgtgacgaagaagaaccattcacaaggatgatggtgtttgagtatgctccaaatggaaacttatttgagcatctgcatgttaaggaagttgagcctcttgactggagcacaaggatgagggttattatgggcacggcttattgtcttcagtatatgcaccatgatctaaatccacctgtagctcattccaacctcaattcaattgctatattattaacagatgactttgctgctaagatatcagagatctctttcggcaagcatgcaaaaaccaacacaactggagatgaatcacataaatcttctgagttgccaccccaggctgatcccgaaaccgatgtctataactttggagtattgttgcttgaaatcatttctgggaaactaccttactctgaagaacaaggccaccttgccaactgggctgctgagcacttgaacgataagcaaagcatcagctatctgatcgatcccacgctgcagtccttcaaagacgaagaacttgatgtcatctgtgaggtgatcaaagattgtcttcaatctgatccaaggttaagatctacaatgaaggaaataactcccagattacgggaagtgcttcatgtatcacccgagcaagctgtcccaagactctctccactctggtgggctgaactggagatcttatca

SEQ ID NO: 3835 - DNA, 792 bp, Glycine Max
cgtcagagaggaaaagggttgcaatggactgtagaagaacacatgaaatttttagttgcacttgacgaagttggcaagggagactggataaccatctcaaaacatattggaacaaaatcttctactcaagttgctagtcatgctcaaaaatactaccttcgccaaaaagccaaaaagaaaataagaaaaagcattcatgacattactttaaatacaatttctcaccaggatgacacacaaaattcaactcctcatccagatcctgaaattcaaccagttcatgaaattcaccaaatgcaagaaatgccaccaaacagcatgactcatcaaatgatccatgaaatacaacaaatgcaagacatattgtcggtgtatccatcaaacaacataactcatcaaatgggtggatttgaacattttgtcaatcaacaagttcatgaaatgccggtgtatccaccaaacaacatgactcatcaaatgagtggatttgaacattttgcgaatcaacaagtccatgaaatgcaacaaatgcaagacatattgtcgatgtatccatcaaacaacatgattcatcaaatgaatggatctgaatattttgtcaatcaacaagtccatgaaatgccggtgcatccaccaaacaacatgactcatcaaatgagtggatttcaatatcttgctaatcaacaagtgttaatgcactactttcatccattttgtttttggaaattccaccaaattatttttgtttactccccgcatagattttggtctctggtctgttttaaggtgtag

SEQ ID NO: 3836 - DNA, 852 bp, Glycine Max
cgtctaaacgctccacacggtgcggagacattggcaatgcaagaaatccatcaagcacaaatggaacaattacacaagaaaattgaggatgacttagaggtctcaagaaggatgctatctttcaatgttatacagggattgggatctcttaagctacactttccagatgtacctgtcatggcattgactgccactgcaaggcatgcagttcgtgaggacatcttgaaggctttaagaattccccatgcacttgttcttgaaagaagctttgaccgaccaaatttgaaatatgaagtgattgctaagacaaaggagccaataaagcagcttggacagttactaattgatcgcttcaggaatcaatgtggaattgtttactgcctttcaaaaagtgaatgtgttgagctctccaaattattgagtgagaaatgcaagatcaaaacagtgtattatcattctggcttgtctgcccaccagagagtagccgtccatattgtatgtgcaactattgcttttggaatgtggatagacaaacctgatgttcgctttgtcatccacaatacaatgtcaaaatcaattgaaagctattatcaagaatctggaagggctggaagagataatttttcttcagtttgcattgctctacaccagaagaaagattttagtagagttgtatgcatgataagaaatggccaaggatataaaaaggaaagttttaagacagcaatggctcacatctatgctgaatgccggagacaaactttactcaaacattttggagaatcttttgatagaagagactgcaagtatggatctagcccctgtgataactgtctcaagactgtattgtga

SEQ ID NO: 3837 - DNA, 249 bp, Glycine Max; identical to SEQ ID NO: 565

SEQ ID NO: 3838 - DNA, 1974 bp, Glycine Max
cgtgccgggtttcgccatgccgcggagtcttattgcgttttggctcacattttgttttgtggaatgttttatcttgatgccagaagtgtcatcaaagagtggattttgttggggagggagtttccgggttgtgatttctttgatatgttgtggtctactaggaatgtttgtaggcctggttttggagtgtttgatactttgtttaatgttttagtggatttggggatgcttgaggaggctaggcaatgcttttggaagatgaacaagttcagggttctaccaaaagtgaggtcttgtaatgagcttcttcacaggctttcaaaatcaagcaaagggggattggcattaagttttttcaaggatatggttgtggctggcctctcgccctcggtttttacatataatatggtgataggctgtctggccagagaaggggacttagaagctgctaggagtttatttgaagaaatgaaagctaagggtcttaggccagacattgtcacttataattctctcattgatgggtatggaaaggtagggatgctaactggagcagttagtgtatttgaggaaatgaaagatgcaggatgtgaaccagatgtgataacatacaattctcttattaattgcttctgtaaatttgaaagaattcctcaagcttttgagtatctgcatgggatgaagcaaagagggttgcaaccaaatgttgtaacttatagtacactaattgatgcattttgcaaggcaggcatgttactggaagcaaataaattttttgttgacatgatacgtgttggtcttcaacccaacgaatttacgtatacatctctgatcgatgcaaattgtaaaataggtgatctcaacgaagcatttaaactggaaagtgagatgcagcaggctggagttaacttaaatattgtcacctacactgcattactggatggtctttgtgaagatggaagaatgagagaggcagaagaattatttggggcattgttgaaagctggatggactcttaatcaacagatttatacttccctttttcatggatatatcaaggctaagatgatggagaaggccatggatattttagaggaaatgaacaagaaaaacttgaagccagacctgttgctgtatggaactaaaatatggggtctttgcagacaaaatgaaatagaagattctatggctgtaattcgggagatgatggattgtggtctgactgctaatagttacatatatacaacccttatagatgcatattttaaggttgggaaaaccacagaagctgttaatctattacaagagatgcaggatttgggtatcaagataacagtggtaacatatggtgtactaattgatggtttatgcaaaataggtttagttcaacaggctgttagatactttgaccacatgactagaaatggtttgcaacctaatattatgatttacactgctctgattgatggcctttgtaaaaatgattgtcttgaagaagccaagaacctgttcaatgagatgctggataagggaatcagtccagataaattggtttatacttctttgattgatgggaacatgaagcatggaaatcctggagaagctttgagtttgcgaaatagaatggttgaaataggtatggagctagacctgtgtgcttatacttcactgatttggggtttttctcgttatggccaagtacagctggcaaagtcgttgctagatgagatgctcaggaaaggcattattcctgatcaagttctctgtatttgtctattgagaaagtattatgaactaggagacatcaatgaggctctggcacttcatgatgatatggcgaggaggggcctaatttctgggactattgacataacagttccctcttgccttactgctgttaccaaattgcacaagctctgtgcttcacagtcaggaactgactttcacagaacagcaaatctttatttggcagat

SEQ ID NO: 3839 - DNA, 1206 bp, Glycine Max
ctaaacgatccacccattcgctatttcttcaattcaggacgtcgttctccacccttgcctcccatggccgacaacaactccttcattcccaacccccatgagccatccaaaccccttgcttgcatcactttcaccaatgtcaccaaacttcttcccaacaattatcctaattggaaacaacaagttgaagctctccttgatggctatgatctcctccaatatccagatggatcttttcctgcgccgtcagaaacgatcctcaccgctccaacatcttcgacgccgactccgtcggaaacgacccccaccactgcatcacttccggtaacaactcagaatcctgcttaccaaacctggcgtcgacaagaccgtcttatatatggtgctctcctcaccactctctctaatgaagtggcctccctggtgtctcaaaccaatacctcgcatgatctctggatccttctcaaaaacacctatgccaaagcatctcgcagccatctcaagcagttaaaggaacgtctccgtacggcttccaaagatctccttgcatcacttggctctcctgtttctgttgaagacatgactgattatgtcttacacggtctcgacgacggctatagagcaatcattgatgccatcaatgcaagggacaccccaatcaattttgatgacctccatgaacggcttctgattcaggaactttcaattggtgctgcccaaagacaaactcctgccccgctgacagccttgaatgctcaggctcgacccaattccaatgacaaatctcggcatggacaaaaccctgcacaatcaactcaacgcactggcactcgcaaaccttttctcgaccgctgtcagtggtgcaacatcaaaggtcatgttctctctcatgtcccaccgccaccttgtaactctccggctcacactggacaggttcaggtcaatactgcaactgtcggcccatcgcaacatgattttctgtttgacagtggagtgacacatcacgtaaccaatgatctcgataatctggcgcttcatcatccgtacactggtcctgactcactgtttatgggtaatggttcaggctcatgtgtggatggactctatctctggcccgccacctcaccctccgtccacacggcttggtcacccttcatcttctattttcaaatttgttcagaaacatttttccttaggctcaaataa

SEQ ID NO: 3840 - DNA, 741 bp, Glycine Max
ctaagagtgagaggatggctgtctgttcatgtgtcaaatatatgtaacttggtgctgtttgtagcaaaggtttatgcatcagttgggagcagatcattggcagtcattgcctcaaccatggattctctcttggatctcttgtcaggtttcatattgtggtttactgcacatgccatgaaaaaccgaaaccaatatcactatccaattggaaagaaactcatgcaaccagtggtaagcgctaagccccacatggatccaacaaaactgcattggatgattgggattatggtgtctgtgaccgtagtgaagttcattctcatgatctactcatatgcacaagatcattttttttatatcattactaattctgttggatgctgtgctagctgtcaagttctactgatagcattgtatacaattaatacatgggccaagactgtcattgagaatgttggttcactcattggaagaacagcaccacctggttttccggccaagttaatttacctcatatggaatcaccatgagcagatcaagcacatggataatgttagagcatacacctttggtgcacattactttgtggaagttgatattgtgttgccagaagacatgcttctccaccaagcgcacaacattggtgagacactccaagagaagctggagcagcttcaagaagttgagagggcttttgtgtacatagattttgagttcactcataggccagagcacaaggccgta

SEQ ID NO: 3841 - DNA, 867 bp, Glycine Max; identical to SEQ ID NO: 566

SEQ ID NO: 3842 - DNA, 1347 bp, Glycine Max
ctagaagacctcaaaaacttacaccaaccaccagattttaacactacaattttctccaagtgtctcaagaacccctctcttaggtactgcagttccaatcccatgatggaccttgaaaaaatattaggattcactattgttgcaagctatctctgcaatgaaccaaagaaccctaattgtgtggagtcattccccaaagttgatcttagaaaccgaccaaacattgcacctctttatttgtcctttgatttcttttggaagtactttcccttaagcattatttccattgacttgtccaacaattctatgaagggtgattttccaattgatgttctccattgcacccaaattcagtctcttgatttaagtatcaatgcattttctggtgacattccaattcaaagtttctctccccttatcaacctcacttttctcaaccgctcctataattgcttttcagagagtaaactctctgattcccaattctccaaaaggtttaactcttctagttttcttcattctggtgctcttttggatcaaaaaaggtttacagttaaggctgtttttctattggttggctttcccatccttgtcattttgatggtaatttacttggtaagtaggaggtttacaccggcaattctaaaggcagcaattgatggtttttcaaataagtatttggtaggaaagagtgatgttgttcacatctacaaagggatcttgagagatggtactgaagtgaaaattgagatgtactgggatgatataccgagggatagttaccgtaaatttgtcgaagaatttaatgttctgtcaaagttacaccacaagaacctttttagagttctggggtggtgtaggagcagaaaattcaggtccattataacagaatggacaagagaagaaaatgttgaaatgtggctatcggtgaaagtgttaatgagagttgtggaatgcatgcgttatctgcaggatgaatggcctgaagttgactatgaactcaacacaagtagtattttattgtctgacaaaatggaaccattaatttcgaggttcaaagttggagatcaaaacagcaaccgaagaaagatatgtaggtttggatttgatggaggtgatgctggatttattaggtacttaagaacccttaatcctgcagatttgcagcaaaaaattgatgagagaatggaagtaactgaaacaaattttcatcaagttaaacaggcattgtctataggattaatgtgcatagaccaatcaaacagtgagaagccaagcttgggcatgatatttaacactatagcaagaggctacaaggctagcctcgtaatctctagacactcctga

SEQ ID NO: 3843 - DNA, 1683 bp, Glycine Max; identical to SEQ ID NO: 567

SEQ ID NO: 3844 - DNA, 820 bp, Glycine Max; identical to SEQ ID NO: 568

SEQ ID NO: 3845 - DNA, 1213 bp, Glycine Max
ctcaattccacggtccataagcttcgttcctcggtcacgtttcttccactcaaggatctccgccatgcacgtgcaccccttgaaggccacacatggttcatgagttccatgtatgacacacacgaagatggtgaggtccaataccagcaattcccatcagaatcatcacatggtaagcttctatgtctcaaaggacgcgacacgcatgacgggtcatggaactcctatgctttggcatggcctgaggctttgccttataacaccaccttcatgagaggcttaacttttgtgtcatataaccattacaactatgagaatttgtggcatggtttatgtgccatggtcccatttgtggcttggcataagatgaataatagctcacaattgccctcaaggtgggttttgtatcattggggtgagctaaggttcaagatgggcctgtgggttgacaccttgatggaggccacctttaatgggccaccaattattgaaaagtttgatggagttaatgaagatgggccagtgtgctttgaggaggctgtggttatgaggcacaatgagggtggcatgtcaagagaaagaagaatggaagtgtatgatctaatgaggtgcaaggctaggatgttttgtaatgtgagcttaaaggggagtgatgtagaaatcaatgatagaggatcaccaatgatagggatgactttgtttttcaggacaggaccaagatcttttaagaatgacacaattgtggctgaaatctttcataaggagtgtgctaagattgaaggttgccggtttatggtagctcattccaataatctcaccttttgtgagcaggtgaaattgatgagtgtgacagatattttgatatctccacatggtgctcaattgaccaacatgtttctcatgcaaagaaacagcagtgtcatggaattctttcccaaagggtggctgaaacttgctggtgttggccaatatgtttaccattggatagctagctggtcaggaatgaaacaccaaggtagctggagggacccaagtggggatgaatgtccatattcagacgatgatcggagatgcatgtcgatatacaagaacggtagaattggacataatgaaaccctattttcagagtgggctagaaatgttttggctgaggtcaagacaagaaagattcaagaaacttcaataaagagaagagcttctagctcttttggtg

SEQ ID NO: 3846 - DNA, 257 bp, Glycine Max
ctctacaacctcgaggacttgccccggccctcgcagatggaccagttgtgtgacaagtggaggccttaccggtccgttgcttcgtggtacatgtggagatttgttgaagccaagggaactccttcgagtgcggtggcggtagccaccgatgctggcttgcagcagcagcagcaccatcaccagcaccaacaacaagagcaacaacagctgcagcaacatcctccacagccacagcttttggatcccatcaatagcat

SEQ ID NO: 3847 - DNA, 1191 bp, Glycine Max
ctctcttctagttccagcatatcaactcatcgctccatattggaccttgacctatccaagtttaccacacagaaacaggtgtcttcactgttccaactatggaagagtgagcatggacgtgtctaccataaccacgaagaagaggcaaagagacttgagattttcaagaataacttgaactatatcagggacatgaatgcaaacagaaaatcaccccattctcatcgtttaggattgaacaagtttgctgacatcactcctcaagagttcagcaaaaagtacttacaagctcccaaggatgtgtcgcagcaaatcaaaatggccaacaagaaaatgaagaaggaacaacattcttgtgaccatccacctgcatcatgggattggaggtatcatttaaaatgtgttaaggatgtacaaaaaataaaaagatactatagggaaaaaagaaatggttgggcattttctgccacgggagctattgaagcaaaaaatgcaatagtgacaggaaaccttgttagcctttctgaacaagaaatcacagattgtgtctataaagccaacagttgtaacggtggatatcactttcatgcatttgaatgggttatagaaaatcgtggaattgccactgaagttgactatccttacacagctgaagatcatggtacatgcaaagccaataagacacagaacagtgttacaattgacaattttggaggtctaataatatcagaacatagtacacaaccagagacagacaaagcactgttgagcgccacccttgagcaaccaattagtgtggccatggacgcaagagattttcatttctacactggcggaatttatgatggaggaaactgttcaagtccgtatgggatcaaccactttgttttaatagtgggttatggatcgttagatggtgtagattattggatagtaaaaaattcatttggaaaagattggggaatggatggatacatttggatccaaagaaatattgctaatccaattggagtatgtgcgattaattttttcgcttcttggccaatcaaagagaaatcagaaacactgagtggattactctcctctttgaaccgtgaaggtggtccagttaactatctagtgcttgttttcttagagacaagcatcgtatgcatgattctgtgttaccatgaatcttccacgctgtattga

SEQ ID NO: 3848 - DNA, 2098 bp, Glycine Max
ctctgtgctgagcttaagtctttggaagatggaaagagggttcattccattatcagttccaatggcatggcaattgatgaggttttgggggctaaactagtcttcatgtatgtgaattgtggtgatttggttaaagggagacgaatatttgatggtatcctcaatgataagattttcctctggaatcttttgatgtctgaatatgcaaagatcggtaattacagggaaagtgtgggtctttttgagaaaatgcaggagttgggaattagaggggattcttatacatttacttgtgtcttgaagggttttgctgcatcggcaaaggtgagggagtgcaaaagggttcatgggtatgttctaaaactgggttttggttcttataatgctgttgttaactctctaattgcagcttattttaaatgtggtgaagttgaaagtgcacgtattttgtttgatgaattgagtgacagagatgttgtttcctggaattctatgattagtgggtgtactatgaatggcttttccagaaatggacttgagtttttcatccagatgctgaatttgggggttgatgtggattcagccaccttggttaacgttcttgtggcttgtgcaaatgttggcaaccttacactgggtagagctcttcatgcttatggagtgaaagctggttttagcgggggtgtcatgtttaacaacaccttactagacatgtattctaaatgtggtaatttgaatggtgcaaatgaagtttttgtgaagatgggtgaaacaactatagtttcttggacttcaatcatagctgctcatgttcgagaaggtctacattacgaggctattggattatttgatgaaatgcaaagcaaaggtcttaggcctgatatttatgctgtcacaagcgttgttcatgcttgtgcttgtagcaactccttggataaaggaagggaggtacacaatcacattaaaaagaacaacatggggtcaaacttgccggtttctaatgctctcatgaatatgtatgcaaaatgtggaagtatggaagaagctaatttaattttctctcaacttccagtcaagaacattgtctcttggaatacgatgattggaggttattcacaaaactcacttcccaatgaagctctacaactgtttctggacatgcaaaaacaattgaagcctgatgacgttacaatggcttgtgtccttccagcttgtgcaggcttagcagctctagagaaaggcagagagatacatgggcacatattgagaaaagggtacttttcagatttacatgtagcctgtgcacttgttgatatgtacgtgaaatgtgggttactagttcttgcacaacaactgtttgatatgattcctaaaaaggatatgatcttgtggactgttatgatagctggatatggcatgcatgggtttggaaaggaggcaatttccacatttgaaaagatgagggttgctggtattgagcctgaagagtcttccttcacttccatcctttatgcttgcactcattctggattactgaaagagggatggaaactctttgattccatgaaaagtgaatgcaacattgagcccaagttagaacactatgcatgtatggtggatctccttatccgctctggaaatctatccagggcatacaagttcattgaaactatgccaattaaaccagatgctgcaatttggggtgccttgctttctgggtgcaggatacatcatgatgtggagctagcagaaaaagtggcagagcatatttttgagcttgagccagagaacacaaggtattatgttcttctagcgaatgtctatgcagaggctgaaaagtgggaagaagtgaaaaagatacaaagaaggataagtaagggtggattaaaaaacgatcaaggctgtagttggatagaggtccaaggaaagtttaatatcttttttgctggtgatacttcacaccctcaggccaaaatgatagactcattgcttagaaaattgacaatgaaaatgaataggggaggttactctaataagattaagtatgcattgattaatgcagatgataggctgaaggaagtgcttctatgtgcacaca

SEQ ID NO: 3849 - DNA, 249 bp, Glycine Max; identical to SEQ ID NO: 569

SEQ ID NO: 3850 - DNA, 309 bp, Glycine Max; identical to SEQ ID NO: 570

SEQ ID NO: 3851 - DNA, 501 bp, Glycine Max
cttttctcaaagaaagcctctggggatttgtttcccgagcaactcgacaacatgatgtgtctcgttgcccgcactggcaggcacttgcagcgctacgacgatggttgtcgccaagttgtgggatgcattccatacagatacaagagaaagggaagccaaaataaggaattagaggttttggtgattagtgctcagaaaggcaatggaatgcagttcccaaagggaggttgggagagcgacgaatccatggagcaggctgctttaagggagaccatagaggaagctggggtcgttggcaacgtcgaaagtaaattgggtaaatggttttataagagcaaacgccaagacacgatgcatgagggatatatgttccctttgcttgtgaagaagcaattagagaattggccagagaagaacattcggaaacgaacatggatgacaattgatgaagcaaaacaagcgtgtccacatccttggatgaaggaggctttggatgtgttg

SEQ ID NO: 3852 - DNA, 1665 bp, Glycine Max
gaaaatattttatttgtcaccttctcaaaaacgcccaacttgaagattattgtagagatattatttgaacactatggatatcaagtgcccgattttcaaagtgatgaagaagcagttaagcgattgggacttttgcttaggaaaattgagggaagttcaatgttgttgttcctggatgatgtttggcctgtctcagaagcccttgtcaagaaatttcaagtcctgatactagattctaaaattttggtaactactagggttggatttcctagattaggcactcagtgtatcttaaaaccactcgttcatgatgatgcaataacccttttccggcattatgcgtcattggaagaaagctgttctaaaaaccatgttttgacccctcaaaataatatgataaattacttgcagcttgggggcctaagtcatagaaatttggttgtgaaaaactgcaagggtttaccactttccatcaaagtgattgggagctcactctgtaatcagccttttgagttggacctagggttatttcctgaagaccaaagaattccttttacttctcttattgatatgtgggcagagttgtatggactagatgatgatggcatagaggcaatgtccatcatcaacaaattagactccatgaatctggctaatgtctcggtagaaagagaaatgctagcaacactctctaacattctttttctgatactctatgattggtttaaatttattgaaaaccaccaattttgtgaaattgagcaccttacacttgcaattcatcaaagcacccaggaaccaattgaacggagaaaaagattgattattgagataaatcaaaataaacctgagtgttggcttggggagaagtcaaaattgcttggctggcgtgttaaacagaagccccaacatgccactgaccacacattgtctatatcaactgatgaaaattgtacttcagattggcccctaatgatgcaactggctcaagaaatattcctttccagatttcatagaagagatgaacaaactaaaagttctgatagtcacaaaatacgactagagtggatttttgttccttcctttgttgcaatgaagaatcttaaaaagttatccctctacacgtgtaatatgaagcaggcatttgaaaacaatcacatgctaattccaaacgcttttccgaatcttgaagagttaaacattgaccattgcaaagatatggtggcattgcctaaggggctctgtgatatcacctccttgaagaagctcagcattactaattgccacaaactctctgcactgccgcaagaaattggaaatttgatgaatttggaactcctaagcctcagttgctgtactgatttggaaggtataccagcttctattggaaggctttcaaatctacgacttatggacatctcaaattgcataagccttcctagtttaccggaggactttggtaatctgtctagtctgcaaaatctctacatgagaagctgtgcaaggtgtgaattaccattctcagttgctaatcttgagaatttaaaggtggtggtatgcgataaagagatagctgcttcatgggacgatttcaagcctatgcttcccaatctaaagatagatacttgttccttaattattttactcgaactccttgtgacttaa

SEQ ID NO: 3853 - DNA, 1962 bp, Glycine Max; identical to SEQ ID NO: 571

SEQ ID NO: 3854 - DNA, 1630 bp, Glycine Max
gaagaagaggagtctccaatagaggaagaggggctaacagtgaagaacaccgacgacccgacccagccggtatggaccttccggatgtggttcccggggctgctctcgtgctccctcctgtccttcctcaaccagttcttcgcctaccgaacggagcctctcttcatcactcagatcaccgtgcaggtggccatgctccccctcggccacgttcgggatccccgggttccggatgaagcgattctccttcaacatgaaggaacatctttgggtccgcctcgtcctacgcggtggggattatatcgttggttgcttcatggcttctcatcatcacggggaattcgaggtttgggaataatccatataaaggagaaatgtggcatgcaccatcattgcctcccatcaccttttctcataatatggttgtggcaatctatagcattatgtagccaaaaaggaaaaaatgttgttgtggtggccttctcaagtttatatatatttacttacatacaaattaaccttgttgataacttgatatgcaaagctttgcaggagaaagatgagcgcagatttttgcaggcatcttgttcagccctcttatctcacccttctttgctattgtcaatgtctttgcacaagaaaattatcaggagtggaagttattatcatccacgagtattagatcttacatgctctaggtatttgtggtacttacaccggtgctccatccacaagacaatgcaaatgcaagtcttttataattttatgagttccacattatttttttgtgttgaaaagagagaacatattgaacagctgatgttttttgaacaattttcttatgagctagtattagaagttttcttatggcaaatcttaggaagatgtgttgtagagcggtatcgtgcttcagcaaagggcaaagaagatatccacacaaaactgatgaaaaaatacaaagacatacctacatggtggttttatgtgatgctggtcgtgacgcttgtggttcagaagccggggtggggacttgtcgttgctgcagccttggcgttcatatttactctcccaattagcatcataactgccaccacaaaccaggatagtttaaccttaggtagaaccatgaagtttgtatcatgtatggtaacatttttagctggacagtcaactaatagtttaagtaacaaagtaagactaaatattattactgagtatctctttggtatcatctaccccggaagatcaatagcaaatcttggtcactacatgaagatccctcctaggtcaatgtttttagttcaggtatattcatcatttcatcggtacaatgcttgctggaaccatcaacattggtgtggcatagaaggaagtcactggacatgtccaagtgaccgtgttttcttggacgcatcagtcatcaatagggccaacactagtttggatattgcacaagacattccccaagcagtcatggattcccttgatcaatcttccggtccttcagggggcaactggaatgatgccaccagcaacaccactgaactacaatgcctggattataattggaacaattttcaacttctttatctttcgctacagcaagaagtggtggcagagatacaactat

SEQ ID NO: 3855 - DNA, 207 bp, Glycine Max
gaagaagatccatttaccatgagtgaggaagttatgaagatgatagcattacaagttatgcgtgaaagtgttacaatattttatatattgacagacatatttattaattcaggaaattcccaacacttcatcactagcaaattaagtcaatgcaagattcttgtggggaagaatgactcaaaaattgggtcaaaatgtaataaatga

SEQ ID NO: 3856 - DNA, 2349 bp, Glycine Max; identical to SEQ ID NO: 572

SEQ ID NO: 3857 - DNA, 1497 bp, Glycine Max; identical to SEQ ID NO: 573

SEQ ID NO: 3858 - DNA, 1416 bp, Glycine Max; identical to SEQ ID NO: 574

SEQ ID NO: 3859 - DNA, 1365 bp, Glycine Max; identical to SEQ ID NO: 575

SEQ ID NO: 3860 - DNA, 195 bp, Glycine Max; identical to SEQ ID NO: 576

SEQ ID NO: 3861 - DNA, 720 bp, Glycine Max; identical to SEQ ID NO: 577

SEQ ID NO: 3862 - DNA, 369 bp, Glycine Max
gagcaagaaataatggaggaccctacttttctccatcagtggcatttgaagacacaatttgtctctttcccaaatcttttctcatttgtggattccaatcagacaactcctccagacagtatctctcaaggaaccttgctggggaatcataataactatgtcttcaaggcatgccaagaagccaaaaagactgggaaacgttataaacattctcaacctcaagaccacatcatagctgaaaggaagcggcgagagaagctcagccagcggttcattgctttatctgcccttgttcctggactacagaagacggataaagcttctgttcttggagatgctatcaaatacttgaagcagctgccggagaaa

SEQ ID NO: 3863 - DNA, 560 bp, Glycine Max
gagggatatagagttgatgttgatgttccagtcaccacacgggcccaagctctaagtttccacaatattctaatttttaacacggggcactggtggtgggccccttcaaaatttgaccctgtgaagtcccctatgcttttcttcaagaatggtcagccagtaatccctccattacgtccagatcaagacctggatttggttttgaagcacatgatcccatatgtggaggggaaaaaagcacgaccaggtgcactcaaatttttccgtactcagtcacccaggcattttgaaggggaagactgggatcagggtggttcctgtcaaagggatcgacctttgagggtgaccttggaagttttgttaccctttcgggtagaagaacttttctctgtgaagaataatgggacaaatgtggagggtcgactcgtgaataaacacctctataaggctctcaaggggtctggtttcattattttggacatcactcacttgagcgagttcagggctgatgcgcacctagcttcgggaggagggaaaaaacacgatgattgcatgcactg

SEQ ID NO: 3864 - DNA, 2466 bp, Glycine Max
gagggcgtaccttggggccgccatatccaaattcaaaattccacgctccacgaacctcactctcactctcttgtcaaccctaacctacctaatcagtccaattccattcttcaaattccgaagccacgcacatcatggcttctcgcaaccacagcaccagcaaaaaggtgggccccgaagaagcttctctcgacaagcggcggtagtagggtcagaacgccgttttccgtcgtcaccaacaccgcagcaacgagtgacactgccaatgcggccgaaggcgccgctgtcgtcgttgatttcacgaaggacgaggtggaggcgttgctcaatgagaagaagaaggggaacacctatgataataagaaaaagattgagcagatgatggatcttattaagcgccttaagctctgcgttcggtggtttaagagaattgaagaagggtatatgcaagaaaaggaaaagcttcaatctgagctagagactgctgagaagaagtgcactgatactgggactgagatgaagagtaagattgaggagttggaagagactgtatctgatttgaggaagacaatttcttctctagaagagagaattgtaaaggaagaatcggataaattggaagcaattaattcttatggtaaagaaaaggaagccagaactgaagctgagaaagttcgggatgagaaatcagctgagcttgagaaagttcgggatgagaaatcagttgctgtgaagaaggccatttcaaatgaggacttgtacaagcgatcacaagagtataatatgagcctgcagcagtacaatagtcgtcttcagtcagatcttgaaactgttaatgaagcccataaacgacttgaaacagagaaagcaacaattgttgagagccttagcaatgtaagaggccacaataaggcattgcaggatcaattggtgtctcttaaagtttcacaagacgaggctataaagcagaaagaaattttagcaaatgagctcaaatgccttcgtgaagagttaaaacaaattagagatgatcgtgattgccaattgggtcaagtacatgctttaactggagaaatagcaaagtacaaagaatatacagggaaaacatgtacacaattggatacgttgatgattaaaacaaatgctcttgaggagacttgttcatctcaaaaagagcaaatacatatactgcagcagcagttgtttgctgaaaaggaaaagtttaagaatgctgacttatcttctttagaaacaagaacaatgtttgaagagcagaagagaattatccgtgaactacaggatcgattggcagatatagaatttcaagttatggaaggagagatgctaaggaaaaaactgcacaacactatcctggagctaaaaggaaatattcgtgtgttctgccgtgtgcggccgctcctaccagaggacagtacaggaacagacatggctgtttctttccctacgtcaacagaagtgcttgatcggggcattgatttggtacaaagcgggcagaagtacaatttcacatttgacaaggtgtttaatcatgaggcttctcagcaggaggttttcatagagatatcacagctggtacaaagtgcacttgatggcttcaaggtgtgcatctttgcatatggacagacaggttcaggaaaaacctatactatgatgggtaagcctgatgcgccagatctgaaaggattgataccacgttctttagaacagatattccagattagccagtctctaaaagaccaagggtggaagtacacaatgcatgtatcactatatgaaatatataatgagaccatcagggatttgttatcattaaatcggtcaagtgggaatgatcatacacgaatggaaaatagtgctcccactcccagcaagcagcacactattaaacatgaatctgacctcgccacactggaagtttgtagcgtggatgagatttcctccctcctacaacaggctgcacaaagcaggtcagtgggaagaacacagatgaatgaacagtcatccagaagccactttgtctttaaattgcgtataagtgggagaaatgagagaactgaaaaacaagtgcaaggtgtgttaaacctgattgatctggctggaagtgaaagactgtcaaggagtggggcaactggggaccggttaaaggaaactcaggctatcaacaaaagtctctcgtctttgagcgatgtcatatttgctttggcaaagaaagaggagcatgttccttttaggaattcaaagctgacacactttctccagccatatcttggtggggattccaaaacgttgatgtttgtcaacgtatcacctgatcaatcttcagctggcgaatcactctgctctctccgctttgcagccagagtcaatgcctgtgaaattgggattccacggcgtcagactcagacatcaacacgctcctcagagtcccggttgagctatggttaa

SEQ ID NO: 3865 - DNA, 1681 bp, Glycine Max
gagggtgaagagaagagaggaatggaagagaaagatttcattgaagagggtaagagtatgagtcgaaaggagaagaggaaggcaatgaagaaaatgaagcggaagcaggcaaggaaggaggaggctgagagggagcggcgggaggaagaggagcgcctgaacaaccccgaggagcagaggcggatgcagttgctggagcagcaggaggctgagaggatgcagagggatatgatcctcttccgagagagagagaaggcgtggatggacactgtcatcactcaaaaacaacaacaacaacagcagcagcaacaagaagacgaggatgatgaatacgaatatgtcgaggaagaaggccctccagagatcatttggcaaggaaatgagatcatcttcaagaagaaacaactcagagttagggttaccgacagggacaaaccaaagcccaacgagactaatcaaaatgaccaccagcaggaggaggataataaacctacatccaatcccttacccccggaatcattgacacttgagaatgttgctcaacaaatacccaattttggaactgaacaggataaagctcattgcccttttcatctaaaaacgggagcttgtcgttttggtatacgctgtagcagagtccatttttaccctgataagtcgtccactcttcttatcaaaaacatgtacagtggtcctggccttgcttgcgaccaggaccaggatgagggccttgagtatacagatgaagaggttgaacgctgctttgaagaattttatgaggatgttcacacagagttcctgaagtttggggaaattgtgaacttcaaggtgtgtaaaaatggttcatttcacttgcgaggaaatgtctatgtacagtataaatcgcttgattctgctctgcttgcttataacacggtgaatggtcgctactttgctgggaaacaggtaagttgtcaatttgttaacttgacacgatggaaggttgccatatgtggcgagtatatgaaatcaggtttcaagacttgttctcatggaacaacatgcaattttatccactgttttcgtaatcccggcggagactatgaatgggccgattctgacaaacctcccccgaaattttgggtaaaaaaaatgatcgctttatttggttattctgatgattatgagacttcaatggagcaaggaaatatgagtttgtcaaaaacagattctgacagatggaagtttgagttgttcaatgtcttgatttatttattttatcatattttaacgtgccactctagaagaaggtcaagatctagggagatggatcagttaaattgcggtcattcaggtagaagaaaacagcgagatgaaagaaagcatagaactcctaatgaggattggaatggcagctttaaaaggaaatcgagaggcagaactcctgattccggtgctgtttctgacagggaatggttagaaaaagaggaaaatagggaaacacaccatgaatacactatgaatagcagacgccatgaagaagattctgatgtggaatgggttactagggacaacgaaaaacagcatggtagagaaggaagaaactcaagaaagcaaaacagagatgagaaaaggcaccatattagcaaaagcaattatcagggtggccgcgatgcttctgaatctgagaaagattttcttg

SEQ ID NO: 3866 - DNA, 1773 bp, Glycine Max
gagggtgttttcttgacgtgggaggacttgtgggtgacagtttcaaatggaaaaaatggaaggaaaccaatacttcagggtctaaaaggctatgccaaaccagggaaactcttggccataatgggtccctctggctgtggcaagtcaacacttcttgatgctttagcaggaaggttaggttcaaagacaaagcaaacagggaagatcctaatcaatggcaggaaacaagcattagcttatggagcatctgcatatgtaacagaagatgatactattttgacaactctaacggttaaagaagcagtatactactcagctaaccttcaattgccagattccatgtcaaagtcagaaaaacaggagagagcagatttcacaatcagagaaatgggtctgcaagatgccattaacaccagaattggagggtggggatctaaaggcgctagtggcgggcaaaagaggagagttagcatttgcattgagatcttaacacatcccaggcttctcttccttgatgaacccactagtggacttgatagtgcagcttcttatcatgtgatgagtagaatatccaacttgaacaaaaaggatggcattcaaaggactattattgcatcaatccatcagccaagtaatgaaatttttaaactttttcccaacctttgccttctctcttctgggaaaacagtttactttggacctacttctgctgcaaacaagtttttctcatcaaatggttttccatgctcaagtcttcatagtccttctgatcacttcgtaaaaaccattaacaaggattttgaacgggacccagagaaaggaatagctggagggctaagcacagaagaagcaattcatgttcttgcaaaatcatatgattcatctgagatttgtcaccaagttcaaaatgaaatagcccaaataaagaaaagggactcggacgcaatggataagaaatgccatgctgacttttcaactcaatgcctcattcttacaagaagatcttttctgaacatgtaccgcgaagtaggctattactggttacgcctactcatctatggtgccttggcattaagtcttggtaccttgttctttgacattggttcaagcagtgaatcaattcaggccagaggttcactgcttgtgtttgttgttacattcctgaccttcataactgttggaggtttcccttcttttgtggaggaaatgaaggtgtttgaaagagaaagactaaatgggcattatggtgtcactgcatttaccattggaaacacattatcttctgttccatttttgctgttgatgtcattgatcccaggagcactggtttattacctagttggacttcaccaaggacatgaacattttgtgtactttatatttatgcttttcacttccctcttcttggttgagggtctcatgatgattgttgcaagcatggttcccaatttcttgatgggtataatcgttggttcgggaattttgggcataatgatgttagatggtgggttctataggcttccaagtgacattcctaagccattttggagataccctttgcactacatttccttccacaagtatgcctaccaaggattgttcaagaatgaatttcaaggtctaacattccctagcaatcaagttggagcacacatgacaattagtggtgaacatattctgagacacatatggcaaatggaagttaattattcaaagtgggtggatgttggtatcttggtaggaatggcagttctatatcgaattctatttatg

SEQ ID NO: 3867 - DNA, 1317 bp, Glycine Max; identical to SEQ ID NO: 578

SEQ ID NO: 3868 - DNA, 204 bp, Glycine Max; identical to SEQ ID NO: 579

SEQ ID NO: 3869 - DNA, 2631 bp, Glycine Max; identical to SEQ ID NO: 580

SEQ ID NO: 3870 - DNA, 1524 bp, Glycine Max
gatactcaagaaaactttgttcaatgtctttacaattatccccatgataacaccaccacctcaatctccaaggttgtttacactcaaaccaactcctcatactcgtctatactagatttttccattcaaaatcttagattttataatgtaacctcaaaacccctagtgattgtaacaccgctggaagtttcccacgtacaagccacaataatctgttcccaacgccacaacatgcagattcgaatccgaagtggaggccacgattacgagggtctttcatacgtatcccaggttccatttgtcgtccttgacctcataaaccttcgagaaatcaaagtggacgtagaaaaccgcactgcatgggttcaagctggtgcaaccattggtgaactttacttcagcattagccagaaaagcaacacactagggttcccagcaggtgtgtgccctactgtgggcactggtggcaacatcggtggtggtggctatggattcatgttgcgcaagtacggtcttgctgctgataatgtaattgatgctgaaatagttgatgtgaacggtaatcttcttgatagaaaagccatgggtgaggatctgttttgggccattagaggaggtggcggagcaagctttggagtcattgtggcttggaaggtaaaactagtcccagttccatcaactgtgacagtgtttagggttccaaggacattggaacagaatgcaaccgagataattcataagtggcagctagtggcaaataaacttgacgataacctgatgattaggatccacctggcaagggtaacttcaagtaaaaatgggaagccaacggtagaagcccaatttgagtccacgtatcttggaggtgtggatcagctcattcccttgatgcaaaagagattcccagagttaggtttggtaaaagaagattgtactgagacgagttggataggttcagttctcttcatgggtaattttacaatcagcggtccccctgaagttttgctgaacagaacgcaattagttggtgtgttaaactacaaagcaaaatccgattatgtgagagatcccattcctgatgttgggttagaagtgttatggcccttgttttatgaagatgaggctcaagctgcttttgttcaattctctccttatggaggtaggatgtatgagatttcggaatctgaaattccattcccacatagatctggaaacttatttcatattcagtatggggtgtattggaaaggggaagggaatgaggaagcacaaaagcacattaactggattagaagaatgtacagttatatggaaccttatgtttcaaagtctcctagagctgcatattttaattacagagaccttgacattggggcaaataacaacaatggatacacaagttacgaccaagccagcgtttggggccttaagtatttcctgaacaactttaagagattggcaacagtgaagacaaaagttgatcctctaaacttcttcagaaacgagcagagcataccttctctt

SEQ ID NO: 3871 - DNA, 624 bp, Glycine Max
gatagtgaagaaattgaacctcaatcaagtgctggaattagtagtgatttaggaaatataaatataagcttatcacaaggaactaatagtgagatgagccatgggaagaggaaaatagatggacctattgaaacactagaaagtaagaaaaagttgaaagttcctacattaaagaaaataacggatgcaatgaatagaattacaacaatctctgagtcacgctcaattgttgtaagcacacccatgagtcgtggtacttctattggtgaagtcatggatgaaatcacacaaatggaggttatcataagtcatatggatctgttttcacgctgttgtcaactaatgattcaattttgtatcaaattagttgaacatggtttgaaaggaactaagcgaactagagttgaacaaatgactggagtattcttatgcatagttgaccatggagaggaaaatagagtgatgcaagagaggtttcaacacttgggaaagactataagtagatattatttagcttatgactctataattacgttgtatcagcctaataactcattaatgaacggggttgaactcatgacggctaagatgggtgacaaaatgactttactaccttctagctaa

SEQ ID NO: 3872 - DNA, 276 bp, Glycine Max
gatcaatattatggaggaatgaaatctctgtcagagaaggtagatgcactttcccagaatcttgtgagggaaacgtctgtactaaataataaagaagacactttgaggagtgaagaagccaacaaagcaaatcttgttaaaaatattgaagaattgaagcattctgtaaaagagaagtcctctgctgttaaaaaggctgaagagggggcaacagatctgaaaaagaaagttgatgagctcacaaagagtctagaggagcatgataaagaataccag

SEQ ID NO: 3873 - DNA, 246 bp, Glycine Max
gatctagggcggttctcggtggaggagcataaccggatgctgaggcaggcgcagaaggaggaggaggaagtgacgttcgaggaagtggtggaggcgcagtcgcaagtggtgtctgggatcaagtactacatgaagatttcggccacgcagggcggcgatggcggagattctagaatattcgaatccgttgtggtggtgaagccgtggcttcgttccaagcagcttctaaacttcgctccttacata

SEQ ID NO: 3874 - DNA, 396 bp, Glycine Max
gatcttaagaagccaagatacaaaaactttgatgaactatatctttgttgttactatgttgctgggacagttggtataataagtgttccaatcatgggcatttcactaaattcacaagccacaacagagagtgtatacaatgctgccttggccctaggaattgcaaatcagctaaccaatatacttagagatgttgaagaggatgctaacggaggaagagtgtatcttccacaagatgagttggctcaagcagggctttcagatgaagacatatttgctggtaaggtgacagacaagtggaggaacttcatgaagaaccaaatcaaaagggcaaaaatgttttttgatgaggcaaaaaagggggtgactgagcttaatgaagctagcagatggcca

SEQ ID NO: 3875 - DNA, 639 bp, Glycine Max
gatgaattcatacagtaccacaattttggcacacttatttggccttcttgctctaatccttttgcttgtttggtgctgcattatcgtgagggcattgaatatgattctcaaaatccacttcgtgttttcaatgttcacccttttatgatgttcttcggattcattttccttattggtctagcaatactgtcacaccaaacggtgccaggatcacatgaaacacgcaagataattcacttgacacttcatttcatagctataattcttgggattgttggtttatgtgccgttttcaagttctatgatatggtgaactgggaggacgtaaccagcctccattcatggattggcattggcaccttttgcttggttggcttgcagtggcttatgggactggggtttatgcttcaaggatcagcacaatcaaggagtacaatggccccatggcacgtagcagctggtagagcactatttttcatggcaatttgtgctgcactaacagggttgatggagaagtacactatgataaaactcgtcacacaccatagagaatctcatttgatcaacttcacgggtcttgcaattctcttgtttggagtctttgtggatatgtcagtgggtttgccacgttatgcatga

SEQ ID NO: 3876 - DNA, 826 bp, Glycine Max; identical to SEQ ID NO: 581

SEQ ID NO: 3877 - DNA, 234 bp, Glycine Max
gatgtagaaatgcctagctatgctgacatgcattatcaactcccatacacacctttggtgatggaagatttcccacaaataaatttaccagagacaaagacaacgaagccagaagtcaccgatgactgcatgttatatgacagatacagggactgcatgaatggaacactagaagagatcatctctttgtgttgcactcaagataattccgtcccttttcctatgctagaatga

SEQ ID NO: 3878 - DNA, 1875 bp, Glycine Max
gatgtatgggtgactgcttctaatagaaagagtggaagcatatcaattcttaagggtctaactggttatgccaagccagggcagctcttggccatcatgggtccttctggctgtggcaaatccacactacttgatactttagcagggcgactaggttcaaacacaaggcaaaccggggagattctgatcaatggacataaacaatcgctggcttatggaacctctgcatatgtcacacaagatgataccttgttaacaaccttaacggtcagagaagcagtgcactattcagctcaactccaattaccagacaccatgtccaaagaagagaagaaagagagagcagatttcacaatcagagaaatgggtcttcaagatgccattaacacaagaattggagggtggggttgtaaaggaatcagtgggggtcagaagaggcgagttaacatctgcatagagatcctaacccgccctaaacttctctttcttgatgaaccaactagtggacttgatagtgcagcttcctattatgtcatgagaagaattgctaccttggctcagaatgacctcattcagaggactgttattgcttctatccaccagcctagtagtgaagtttttcaatttttcaataacctttgtcttttgtcatcaggtaaagcagtttactttggacctgcttctggtgtaagtgagtttttcgcttcaaatggttttccctgtcctgttctcatgaatccttctgatcattttctgaaaactataaacaaggatttcgatcaggtaattaagttgaccaagttttcaaggcaatattggtgctttaattttgtcacgattcaattctccaaaaatacccacagaagaagcaatccacattcttttcaaaacgaagtagctgcactatctacaaaggatattagttcaatagactggaagagagggcatgcgggcttccttaatcaatgcctagttcttactaaaagatcgttcgtgaacatgcgtcgtgatctaggctattacttgttacgccttgccatatttgttgcattggcaatagctttggccactattttctatgatttgggtacaagttacgtctcaattcaggatcgaggttcacttgttgcatttattaatggattcctaactttcatgaccattggtggattcccttcctttgtggaagtcatgaaggtatttcaacgagaaaggcaaaatgggcattatggtgtcactgcattcgtcattgggaacaccttgtcgtcgattccatacttgttattgattacaattattcctggggctatagcttattaccttcctggtcttcataatggatgcgagcactttctgtatttcatttgtgttttattttctagtctcatgttagtggagagtcttatgatgatagttgcgagcgttgttcccaactttctaatgggtatcatgactggtgctggaattctaggaatcatgcttttacttggcgggttctttaaattgccacatgatattcctatcccggtttggagatacccattacactttgttgcttttcacacgtttgccaaccgtggaatgttcaagaacgagtacgaaggactaagatttgcttccaatgaagttggaggaggttacataagcggtgaagaggttttgagatatgcatggcaagttgacatgagttactcaaagtgggttgatcttgcaatcttgatagggatgatttttctttatcgagttttgtttttggttatcatcaaggttaaagagaaggtgaggcccgttgttgtatcattatcatgtatgtcagcgtcttccaagcgaacaatacaagtcatggaaaatcccaacgccactcctttacattga

SEQ ID NO: 3879 - DNA, 591 bp, Glycine Max
gattttgatttgacagggcagctggtttggcctggagccatgttgctgaatgagtatctttcaaaaaatgttaacctgcttcagggttgcactgccattgaattaggttctggtgttggtattaccggaatactttgcagcagattctgccataaagttgtgatgacagatcataatgaagaagtgatcaagatcttaaagaaaaacatagagctgcattcatgtcctgagaatattacttctatttctcatggattagtagcagagaaactagaatgggggaacactgatcagataaatgaaatattacaaaaacatcctggaggtttcgacttcatacttggagctgatatatatatcctttatcagtcaagcatacctatgctttttgatagtgttaaacagctcctgcaggctagggaggacagaaagtgcaaattcattctagcctatatatcaagagctaagaccatggattcaatgattcttattgaagcttctaagctacagatgcagatgaaagaagtgcctggaactcggtgcacagttaagaatcttgaaggagtcatctttgtagttactcttgagtag

SEQ ID NO: 3880 - DNA, 50 bp, Glycine Max; identical to SEQ ID NO: 582

SEQ ID NO: 3881 - DNA, 432 bp, Glycine Max
gcagcacagattgaatgtatcttgagagttcagaagaagcaagaaacgtttgcatgctttgaggaaagtagggatatggtaaggactaaagctgaaaggttacaaaatgagcacccaagatgcttggttgatggaaatgagctattgagatttcatggtacaacaattgcatgcttccttgaccaatgtggtttgtgtcaaattttgaggcatggtttctccgccaataaagaatttcatggtgcacgtggggtttacacaccacttctactagtggaaaaaccattgattccatttgttcatcatccaataaatctgttaatagctgggagaatccataatcctctacaagagatcaaggaagtggttgatcccgagtttgattctttggtaaagaaaatgagtgaccaatcagagattgaacaactcatt

SEQ ID NO: 3882 - DNA, 3261 bp, Glycine Max
gcagcagcagtttcctccatcaagactgatgcacaggctcttctcatgttcaaaaggatgattcagaaggatccaagtggagttttgtcagggtggaagctgaataagaatccatgcagctggtatggagtcacttgcacccttggaagagttactcagcttgatattagtggaagtaatgaccttgctgggactatatctcttgaccctttgtcttctttagatatgttgtctgttctgaaattgtctttgaattcattttctgtaaattctacctctttggttaatctcccatatagtttgacacagcttgatctatcctttggtggagttacaggtcctgtgcctgagaacctgttctccaagtgtccaaatcttgttgttgtgaatctttcttacaacaacttgacaggccctattcctgaaaatttctttcaaaattctgataaactgcaggtccttgacctctcttccaacaatctgtcagggcctatttttggcctgaaaatggagtgcatttccttgttgcaacttgatctatcaggaaaccgtttgtcagactcaattccactatccttgtcaaactgcaccagccttaaaaatttgaatttagccaacaatatgatttctggggatatccccaaagcttttggtcagctaaacaaactacagactttggatctttcccacaatcaacttattggttggatcccttctgaattcggaaatgcatgtgcttcccttttggaactcaaactttctttcaacaacatctcaggctcaatcccatctggtttctcctcttgcacttggctgcagcttcttgatatatctaacaacaatatgtcagggcagttaccagattcaatctttcagaaccttggatcattacaggaactgaggctgggaaataatgctatcactggtcaatttccatcttcactatcttcctgcaaaaagttgaagattgtggatttcagctcaaataaattttatggatctctccccagagatttatgtccaggagcagcctcacttgaggagctgagaatgccagataatctcattacaggaaaaatcccagctgaactgtcaaagtgctcacagctgaagacacttgattttagtctgaactatctcaatggtacaatccctgatgagcttggagaacttgaaaatcttgagcagctaatagcatggttcaatggcttggaaggaagaattccaccaaagttgggccagtgcaagaatctcaaggatctcatactgaataataatcacctcacaggcggaattcccattgagttgttcaattgcagcaatcttgaatggatatcactgacaagcaatgaactcagtggcgaaataccgcgcgagtttggcctcttgacaaggttagcagttttgcagcttggaaacaacagcctgtctggggagataccatcagagctagcaaattgcagcagtttggtgtggttggacttgaacagcaacaagctcactggagagatccctccaagacttggaaggcagcaaggagcaaaatccttgtttggtatcctttcagggaacactttggtgtttgtaagaaatgttggaaactcatgtaaaggggttggaggtttgctagaattctccggtattcgacctgaaagactcttgcaggttccaacattgaggacttgtgatttcacaagactctattctggtcctgtcctcagcctgttcaccaagtaccagactctggagtatcttgatctttcctataacgagctccgtggaaaaatcccagatgaatttggagatatggtggctttacaggttcttgaattatctcacaatcagttgtctggagaaatcccttcgtcacttggccagctaaaaaatttgggtgtgtttgatgcatcacacaatagactgcagggtcatatcccagactcattctcaaacctctcattcttagtccaaattgatctatctaacaatgagttaacagggcagattccatctaggggacaactaagtacacttccagcttctcagtatgcaaataacccaggcctttgtggggtaccattgcctgattgcaagaatgataacagccaacccacaacaaatccaagtgatgatattagcaaaggaggccataaatcagcaactgcaacatgggcaaacagcattgtcatgggaattctcatctctgttgcttctgtatgtatcttaattgtgtgggcaattgcaatgcgcgcaaggaggaaggaggctgaggaagtcaagattctcaatagcttacaagcatgccatgctgctacaacatggaaaattgacaaagagaaagagccattaagcattaatgtggctacatttcagaggcagctgaggaagctcaagttctcacaactgattgaagcaacaaatggcttctcagcagcaagtctcattgggtgtggtggttttggtgaagtgttcagggccacactcaaagatggctcgagtgtcgccataaagaagctcattcgactgagctgccagggcgatcgagaattcatggcagagatggaaaccttagggaagatcaagcacagaaatcttgtccctttgttggggtactgcaaagtaggggaggagaggctccttgtttatgagtacatggagtatggaagcctagaagagatgcttcatgggaggatcaagacacgtgatcgacgcattttgacatgggaagaaaggaagaagattgcaagaggtgctgctaaaggactttgtttcctgcaccacaattgcatccctcatataatacacagagacatgaaatcaagcaatgtgctacttgaccatgaaatggagtccagggtctcagattttggcatggcaagactaataagtgcccttgacacacatcttagcgtgagcacactagcaggaacacctggatatgttcccccagagtactaccaaagtttcaggtgcactgccaagggagatgtctactcatttggagttgtgatgttggaactgcttagtggtaaacgccctactgacaaggaggactttggtgacaccaacttggtggggtgggcgaagattaagatctgcgaagggaagcaaatggaagtgattgacaatgatttgcttttggccactcaaggaactgatgaagcagaagcagaagccaaagaagtgaaggagatgataagatatttagagatcactatgcagtgtgttgatgacttgccttcaagaaggccaaacatgttgcag

SEQ ID NO: 3883 - DNA, 1686 bp, Glycine Max
gcattcgccgaagcttcgggtctccggcgagcggtggagctaatcttttcagtgctctctctctcgtacccgattcgcgtcttctccggaaaatggcagctgattcgggccaagttggaggagcttcacgccggcctaatcgccgccgagaaatgcgactccggcgagagcccgtccctctcgcggctggctgcggcggtggtggccaccgcgacggagtgccacgatctgtgccggcgttgcgtggttttctcatacagcggaaagcttctgttgcagagcgatttggacgtggcgttcgcgaagctcgatgcacacgcgaagaagctcaacgagatatacaagactggaattttaactaatgggttcgcgttggtggtttcaaaaccgagtcttgccgcttccaaagaggacatgaggttctacgtgagggacttaacgacgaggatgaaggttggggatttgggtatgaagcgacaagcgctgaagaatcttctggaagttgtggtggaggatgagaagtacgtgaaggtgattgttgatgttggtgacgtggttcatttgttggtggggtttttggggtcaaatgaggttgagattcaggaggagagtgctaaggttgtttctgttgttgcggggtttgattcttacaaaggggttttgattggcgcgggtgtaattgctcctttggttaaggttttggattgtgggagtgtgttaggtaaggttgcggctgcaaggtgtttggtgaagttaactgagaattcggataatgcttggtgtgtttctgctcatggaggggttagtgtgttgttgaagatttgtggtggtgattgtggtggtgatttggttggacctgcttgtggggtgttgaggaatctcgttggtgtcgaggagattaagaggtttatggttgatgagggtgctgcggtaacattcattaggcttgtgaggtctaaggaggaatcgattcaggtgaattcgatagcgtttattgtgagtattgcatctggtgatgaggttgttaggcagatggtgatcaaagagggagcgattcacgctttgttgcgcgttttggatcctaagtggtcttattcttgtaaaacaagggaggtggcaatgagggctattgaggatttgtgtttttgctcacctagttctgttggtgttttgatgagttatggctttgtggatcaattgatatattatgttcgaaatggcgaggtttcgattcaggaattggcattgaaggtggcgtttaggttgtgtggaacatcggaggaggccaagaaagcaatgggggatgccaggtttatgccggagtttgttaagtttctcaatgcaaagtcatttgaggttcgggaaatggcggcggaggcactctctggcatggttatggtgcctagaaatagaaagaggtttgtgcaggatgatcataacatagcccttattctgcagttgcttgatccagaggaggggaattcaggtaataaaaagttcttgatctctatattaatgtccttaactaattgtactagtgggaggaaaaagattgttagttcaggatatgccaaaaacatagaaaagcttgcggatgctgaagtttcttctgatgccaagagacttgtcaagaagctatccacaaaccggttccgcagcatgttgagtggaatctggcgctcgtga

SEQ ID NO: 3884 - DNA, 1665 bp, Glycine Max; identical to SEQ ID NO: 583

SEQ ID NO: 3885 - DNA, 1275 bp, Glycine Max
gccattaatgattggcttcctgtcactgcctcccgaaatgccaaatggtggtactctgccttccacaacatcactgccatggttggtgctggtgtcctcacccttccttatgccatgtctatgatgggctggggtccggggacagttatactgctcttgtcatggatgatcacgttgtttaccctatggcaaatggttgagatgcacgaaatggtacctggtgtgagattcgataggtatcatgaattggggcagcatgcctttggagagaagttgggtctctacattgtgattcctcaacaactacttgttcaggttggcacatgcattgtatatatggtcacaggaggaacatcgctaaagaagtttcatgacacggtttgcccctcgtgtcaaaacattaggacctcctattggattgctatctttggttttgtaaacttcgtcctctctttgtgccccaacttcaactctatttctgctgtctcttttgccgcagcagtcatgtctatcgcttactcaaccattgcttgggtggcttccattggcaagggaaaactaccagatgtggactatggctacaaagcccacagcactgccgatggtgtattcaacttcatgttggccttgggagaggtggcattctcctatgcaggtcacaatgtggttttggaaatccaagcaacaataccttctactcctgagaaaccttccaagaaagccatgtggaaaggagttatatttgcctatttaggagttgccttttgctatctccctgtggccttcattggatattatatatttggcaactctgtccaggataatatcctcatcacactagaaaaaccaacttggctcattgctgcagccaacatgtttgttattgtccatgttattggaggctatcaggtattctcaatgccggtgtttgacatcatcgaaacctttttggtgaagcatttaaagttttctccttgttttacactccgctttgttgctcgcactgtatttgtagcaatgtcaatgttaattgccatatgcatcccgttcttcggttctcttcttggatttctaggaggatttgcctttgccccaacatcatactttctaccctgtatcatctggcttaaactctacaaaccaaagagatttagtttgtcttggatagtcaattggacatgcattgtgcttgggatgctattgatgatactagctccaattggttcgttgagaaaaatcattgtttcagcggcgaattacaagttcttttcgtga

SEQ ID NO: 3886 - DNA, 1137 bp, Glycine Max
gcccgcttatctgggcccaccaccactcctcctcctcacacgcttcctcccacttcccagattcaagacgatgacgtttcggttcccgctgcggtttcttcttcctccccttggtcttccggggagcactacgtgggcaggggcagtgtcggtagattgaatttgagacacggcgaaaggagcgtgcttttcaccgattccgattccttcactacttcacacgacgatgacagtgatgttggtggagagagggagagagcgggtctcgcttctaattctgcagccgctgatgagttggttattccgtttaactcatccaacgagtggtttagacagactttcgcttcgtggcagaaaggtgacgtcttgggaaatgggtccttcggaactgtctatgaaggcttcaatgatgatggattcttttttgcggtaaaggaggtgtctttgctggatgaaggtggccagggaaaacagagcttttttcaacttcagcaggaaatatctcttttgagtaagtttgagcataaaaacatagttcgatattatggctcaaacaaggacaaaagtaaattatatatattccttgagcttatgtcaaaagggtcattggcaagtctctatcaaaagtatcggttaaacgattctcaagtttctgcatacacaaggcagattttatgtggcttgaagtatcttcatgatcataatgtggtccacagggacatcaagtgtgctaatatactggttaatgtaagggggcaagtcaagcttgcagattttgggttggcaaaggcaacaaaatttaatgatattaaatcaagcaaaggctctccatactggatggccccagaggttgttaacttaaagaatcaaggtggttatgggctagcagctgatatatggagcttagggtgtacagttttggagatgttgacaagacagcctccctattctgatttggaaggaatgcaagcattatttcggattggccggggtgaacctccacctattcctgaatatttatctaaggatgcccgggatttcatccttgaatgcttacaagttaacccaaacgatcgtccaactgcagctcagctattttatcattcttttctaaggagaacagttctatctccctga

SEQ ID NO: 3887 - DNA, 616 bp, Glycine Max; identical to SEQ ID NO: 584

SEQ ID NO: 3888 - DNA, 1269 bp, Glycine Max
gctgaaacaagcttggatgttgaaattcaagcattgaaagctttcaagaactccattactgctgacccaaatggggctcttgcagattggcttgacactcaccaccactgcaactggtctggcattgcatgtgatccatcttcaaatcatgtcatttcaatttcctttgttagtcttcagctccaaggggagatttcacctttccttggaaacattcctggccttcagaagagcatatctattattgcttcacttggatcacttgctatactactattattagtcttggtgattctaattctcaatagaggtatcaaactctgcaattctaaagaaagggatattagtgcgaatcatggaccagaatacagttcagcattgccacttaaaaggttcaatccaaaggacttggaaaatgcaactggttttttcagctatgacagcatcattggtgctagtagtttgagcacagtttacaagggtcaaatggaagatgaccagtttgttgccataaaaagattgaatttgcaacagttctctgtaaatactgacaagatcttcaagagggaagccaaaatcttgtgccagatgagacataggaatttggttaaggtacttggatatgcctgggagagtgggaaaatgaaggctttggttctagagtacatggagaatgggaatttggatggcataatacatgacaaagggaaagatgagtctgtgatctctaggtggacattatctgaaagagtccgagttttcatttctattgctagtgcattggattatctgcactctggttatgattttcccattgtacactgtgagttaaagccttctaacatccttctagatagagattgggaagctcatgtcagtgactttgggacagctcgaatacttggccttcatctgcaggatggtagtaccctttcctcatctgcagctttgcaaggcacattgggctatatggcaccagaatttgcctacatgaggaaagtaaccactaaagcagatgtgttcagcttcggtgtcatagatggtttgccaatcactttgcgtgaagtagtgacaaaagcccttaaaaatggaataaaacaacttgccaatattgtagaccctttgtttacctgggatgttgaccatgacgaagtgttgccagagctcattaagttatcattgtgctgcaccctcccagatcctgaacatcgaccaaatatgaatgaggtgttatcttcccttgtgaagcttcaaacaacactgtcttga

SEQ ID NO: 3889 - DNA, 219 bp, Glycine Max
gctggtagggaaggatcacttcttctcggagaatgcggaaacgcatgtgagtatcgttgctcagagactcatcacaggaagccatgtctgttcttctgcaacaagtgttgtaagacatctttatgtgtcccatcaggaacctatggtcacaaggaggaatgtccttgctatataacaattggaataccaaggaaggaaaacccaagttcccttaattaa

SEQ ID NO: 3890 - DNA, 911 bp, Glycine Max
gctgtagctgacatcattattaccaagcactttcattcagagatagatcctgacatgatatgtgctattgctgaacttgaaagtgatagacaactacttgttatgaattccagacacaaatctaaagagcctaccgtggggcttatgcaactcctgccaaaaactacagagtggttgatgaggaaggcgagccctggtgcagcggtaaagttgtgccttggtgacttgttggtcatgggttcgaatccggaaacagcctctttgcatatgcaaggaaaaagaagtgaagaatttattgtaagggcatataaaggtggtacaaagaaggcaactcataaatccactttgcgctattggaattgctatctctcagttaaagaaagttttcgatccagaaaatctgttgatgacaatgtttcacctcctgctcactctcatcccttaccttcattagaaaactcaaaagatgcaagtgttgacacatattgggattccagagtagccccagaagatatggaagctatgtggaatcatcttgaggttcgaaaagagtggaataaatccaaacaaaaacaaggaaaggtgcggtttgcacatgatgaaaagaagagaccatatctatcccgagtagaaatgaaggcaattgcagatataattctatacaaatacctcagcacagtgaaaattaaatcctttagggttattaagctaactaatcttcagagaagaaaggaaatttcaatacgttttttgagtcgccattatgagattatgaaatttaacaaatattcaaaaatgcccttaaaacgagatttctgggaattgggctatagggcttatagacttgaatctgttgatgatcttaacaatccatttgtgtccatgtactttggtgctgcttatgtagcatg

SEQ ID NO: 3891 - DNA, 1338 bp, Glycine Max
ggaaaactaatactaacaatctccaaacctcttctgctcctccaatcaaaactctactgtttctctctgttctatctcttcacctctctcttccttgctctttacgtcatttcctctcaatccaaatgcctcttcagatcaaccctttacgatccaattcaaccttcttcttctctcttttcttatccttcttcctatggacagcacaagtatgccatctcaaccacacgttctacctgctcttcccctgtaaatttttcagattactgggatgttttgaaggagattcagaatttttgcaaattttcgacgaggactgtgaggtgcatgcagggaaatgctgatagtttcggtgggaatctcagcacccatttaaggttttttcattttgatcaccaaaacgatagcagtgaagtgccatgtgggttcttaaataaatttccaattagtgattatgatcgaatatgcatggaaaagtgtgaaagtgtagttgtagtttcagcaatattcaatgaccacgacaagatccggcaacctaggggccttgggtcccaaacactacaaaatgtttgtttcttcatgttcatagatgatattacactcaaaggacttgaataccttgggttaatttcaacaaaatccagagaatacaagataggagtgtggaggattgtgaaggtttcaaaagaggatttgtatcagaacccagcaatgaatggggttataccaaaatatttattccataggctattcccatattccccaattcagtatttggatagatgcaaatcacttggtatatctcagaatgcagacatggctatatcaaagcacccatattttgttcataccatggaagaagccatcgcaacagcacggtggaagaaatggtgggatgtgaatgccttgaagatgcaaatggagacctactgtgaaaatggattgcaaccatggagtcccaccaagctgccctatgcctcggatgtgccagacagtgcactgaccctgaggaagcatgaactgagcagtgatttgttctcctgtcttatattcaatgagttggaggcttttaacccaagagaccaattggcttttgcatttgtcagagaccacatgaaacccaagctgaagctgaacatctacgaggttgaagtttttgaacaagtgacaatggagtacaggcacaatctgaaaccaagtgatttgtacatagccaagaaattgtccatgacaagaaaaactgtaagggcagaaccagatttgttgtatgaaaatggaagctgttgcagcaggtgccaccattatcttaccaccatgtggggtgattctcatcaatag

SEQ ID NO: 3892 - DNA, 1560 bp, Glycine Max; identical to SEQ ID NO: 585

SEQ ID NO: 3893 - DNA, 1401 bp, Glycine Max
ggaagagtcacatatccagaacaaataaatctttgggatgatagttcaaatgaaccaaaagacttcactaccaacttttcctttgttgtttcttcaaatcagagtagtctctatggagatgacgatgaaaagctaagaggaggagcccttagcataggccttgtggatggtgaccgaaatcttctcgagacacattatcaatttgtggtgaagtctcaaaaactagagaaatggtggacaaatgttacacaaggggaagtttgtaactgcagtattgtatacaattctagaaacaatattttgaaagtttctttcactgagaacaaattaggtggtggagatgcaacacagattattcagcacctttcataccacgttaatatcacggatcaattatcaaagtcggttactgttggcatatcagctgcaacaggagaatacactgaggaacataccctgttttcatggtcatttaggccattcaaagaaaggaagaatcaacactatattgttggagggaactggaattggtacaggatgagaagaagaaaagagggacgcacttcagaagccacttctcatctgaagatgaatgataaattccaagagaccaaaagagattacgacacagaagtttggccaaggtggtttggtggctttcataaaggttatttcaagggcttaaactcctatgctgctatgaagaggatatcagcaggttcagcgcaaagtttgaaggaatacgcagaggaagtaacgatcattagccaattgaggcacatgaatttggtgaaactcgctggttggtgccacaagaagaatgatctctttctgatatatgagtatatgccaaatggcagcttagattcttgtctttttggtggagaaaagttcttgccatggaaggtgaggtacaacgtagctctgggcctggcatcagcatggctttaccttcaggaagaatgtgaaaaatttgtgtttcatagggaaatcaagtcaagcaacataatggttgactccaatttcagtgctaagctaggggattttggcctggctaggcaagtggaccatgagaaagggtcacaaattcctgaatgtatgaacacagacaaggctcggaggaatccgacacattcagtttcgggaaaagccattcaccacaaagacatggagggtggagtatcattagttgagtgggcgtgggagcaccatggattgagaaatctccttgcagcagcagatccaaacctatgtgcagaatttgatatccaaacctacatggcgaatttgatgtgccgcaaatggaatgcttgcttgcccaaaacaaggccctctataagacaagtgataaaggtgcttaactttgaagctccttttccaattctcccaccacagatccct

SEQ ID NO: 3894 - DNA, 366 bp, Glycine Max; identical to SEQ ID NO: 586

SEQ ID NO: 3895 - DNA, 181 bp, Glycine Max; identical to SEQ ID NO: 587

SEQ ID NO: 3896 - DNA, 234 bp, Glycine Max
ggctggtggagtggaggatttgggtatgggctgtggattggcatcttagttgcctcaggattttctgttattccagtgccatcgtttacttggaaagcaaaatttgaactctctggaaacgggactacaaaggatgatagcaggagaattgcatctacattatttccttcaatgacttccatgctaagtaggaaaaaagatcatggtacttctcttgttttgcatgttatttaa

SEQ ID NO: 3897 - DNA, 381 bp, Glycine Max; identical to SEQ ID NO: 588

SEQ ID NO: 3898 - DNA, 2973 bp, Glycine Max
gggaagctgtttgtggcttgtcatgtgtgtcgtttccccgtttgtcgaccctgttatgagtatgagaggagtgaagggaaccactgctgccctcaatgcaacacccgctataagcgtcataaaggttgtcctagagtagctggtgatgacgaggaacattctgatgcagatgattttcatgataatcctgacgagaaacatgatgttaatcatttggaaaataaagactacaaggaacagcagtggcatcccaatggtcaagctttctcttcagctggaagcgtggtcggtaaagaatttgaaggggagaaagaattcttcagtaatggagaatgggaagaaagattagataaatggaaagccaggcaagaaaagagagatcttcaaaacaaagaggaaggaaaagatgaccaaggtgaagatgactaccttttggctgaggcaaggcaaccgttgtggcgtaaggtgccaatatcttcaagcctaatcaacccatatcgcatagtgataatcatgaggctggttatcctagttttcttcctccgtttccgtatcttaactccggcatacgatgcatatccactgtggcttgcctctgtgatatgtgaaatatggtttgcactgtcatggatacttgaccagttccccaaatggttccccataactcgtgaaacttacttagatcgcttgtccataaggtttgagcgcgaaggggaaccgaaccttctagctcccgttgatgtttatgtgagtactgtggaccctttgaaggaacctcccattatcacagcaaacactgttctttcgatcctcgctgttgattaccccgttgagaaggtgtgctgctatgtatctgatgatggtgcatctatgcttctgtttgatacactgtcagaaacttctgagtttgcaagaagatgggttcctttttgcaagaagtatagcatagagccaagggcacctgagttttatttttctcagaagattgattacttgaaagataaggtgcatcccacctttgtgaaggaacgaagggccatgaagagagaatatgaagaatttaaagtgaagattaatgccttagtggcaaaagcacagaagaaaccagaggaggggtgggtaatgcaggatggaaccccttggcctgggaacaacactcgtgatcatccaggaatgattcaggtatatttaggtagtggtggtgcattggacgtagaaggcaaggaactgccacgaattgtgtatgtttcacgtgaaaagcgtcctggctataaccaccacaagaaagctggtgctatgaatgctttggttcgagtttctgctgtgctttcaaatgcacctttcatgttgaatctggactgtgaccattacatcaacaatagcaaggctataagagaggctatgtgctttttgatggacccccagctagggaagaagctctgttatgtccaatttccacaaagattcgatggtattgatcggcatgatagatatgctaatcgcaacattgtgttctttgatatcaatatgaaagccctagatgggattcaaggtccggtttatgtcggtactggatgtgtgttcaataggaaggcattatatggatatgatccaccagtatctgagaaaaggccaaagatgacttgtgactgctggccttcatggtgttgctgttgttgtggaggttcaaggaaatccaagtcaaagaagaaatcaggaggaggagggggcctatttagtagattatacagcaagaaaaagaaaacgatggggaagagttatgttaggagagggtatgagtccatgtttgatcttgaagagattgaagaagggcttgaaggctatgatggactagagaaatcatccctcatgtcccaaaaacaatttgagaaacgatttgggcagtcaccagttttcattgcttccactctaaaggaaaatggtggaattcctgaaggcaccaatagccaatcactaattaaggaagctattcatgttataagttgtggctatgaagagaaaactgaatggggcaaagagattggatggatttatggctcagtcacagaagatattttaacagggttcaaaatgcattgtagaggatggaaatcagtatactgcatgccaaagagaccagctttcaagggatctgccccaataaatctatcagataggttacaccaggttctgagatgggctcttggttctgttgaaattttccttagtcgccattgcccattgtggtatggctatggaggaaaactgaaatggctagagagatttgcttatactaataccattgtttatccattcacttccatccctctacttgcatactgcacaattccagcagtgtgtcttcttactggaaaattcatcatccctactttgaccaaccttgctagtgtatggttcatggctctattcatctccatcattttaactagtgtccttgagcttaggtggagtggggttagcattgaagacttgtggcgcaacgaacaattttgggtcattggaggtgtttctgcacaccttttcgccgtattccaaggtctcctcaaggttcttggaggagtggacaccaatttcactgtcacagccaaagcagcagatgatgctgaatttggagagttatatctgttcaagtggacaacacttctcatcccaccaacaactcttataatcttgaatatggtgggagttgtggctggagtctctgatgccattaacaatggctatggttcatggggtcctttgtttggaaagttgttctttgcattttgggtcattgtccatctatatcctttcctcaaaggtctcatgggaaggcaaaacaggactcctactattgttgttctttggtcaattcttcttgcatcaattttctctttgatttgggtcaggattgatcctttcttgcccaagcaaactggtccagtgctcaaacaatgtggagtagaatgctaa

SEQ ID NO: 3899 - DNA, 693 bp, Glycine Max
gggtttggaaaggtgagaaagcaacgagatgggaagctacttgtcaagggttcaagcaagagtttgaacctaacttcatcgcaaaatgaggttcgtgttgatgtgcttggagctagtggctacagtggttctgaggttctgcaactgttggcaaatcatccacagtttgggattgcactgatgactgctgataggaaaagctgggcagccaatctcttctgtattcccacatttgagcacttgggtttgggtgacttgccagatttgattgcaataaaggatgccaacttttctgatttggatgttgtattctgttgtttgcctcatggaactactcagtttgcgaagagagcactggttaaagtatatcaaatatcaatgcttaaaaaaattattaaaggcctagcaaaggacttgaggattgttgatctttctgcagattttcatctaaaagatctttctgagtatgaagagtggtatggtcaaaagaagctatatatgtatggattgacagaggttttaagggaggaaataaagaattcacatctagttgctaatccaggttgttatccaacttctgttgaacttcctcttgtcccattgataaagtgtgttaagcttcatgtacttttaagggaatcaatgtttcagatattgtccactgctagaaccaacaatcaggtgtctgtagta

SEQ ID NO: 3900 - DNA, 249 bp, Glycine Max
ggtttgcaccaaagcattggagagtgtttggcagagccagaaatggactcagagagcaataggagagttctggaaggtgtgcagcacataaagtacattagctatgggacactgaagagggacatggttccatgtgatagagcaggagcttcttactacaattttcatgcaagaccagctaatccttataataggggctgtgaggtcattactggatgtgcaagaggtgttcaaggcatcaaaacttga

SEQ ID NO: 3901 - DNA, 1566 bp, Glycine Max
gtaaaattagctttcctttctatcacagttttcatttcaattttcccttcagcctctacttctgctggccacgataaaggtttccttcaatgttttcaaacaatgttaggagttgacaacacaacttcaggagtaatattcaccaaaactagttcttcttatgaacccattttgaagtcttctataagaaacgccagattcctagacacttcagtcccgaagccaaacctcattgttactccacataacctattccacatccaagtagcactgttttgctcaaagaaaagtggcttacaagtaagaattcgaagtgggggccatgactatgaaggcctttcatatgtctctcacgttccattcataatcattgatcttttcaaccttaggtccataaccattaacatggacgaagaaactgcatgggttgagtcaggtgcaacacttggagaactctattatgcaattgaaaagaaaagtgaggttcatggtttcccagctggaagttgctccactgttggtgttggagggcatttgagtggaggtgggtttggtacaattttcagaaaatacggcttagcttctgataatataattgatgctcaaattataaatgttaatgggaagatactgaacagaacactgatgggagaagatctcttttgggccataagaggaggaggagggtctagctttggagtcattactgcatggaaaatcaagcttgtacctgttccttcaaaagtcgcaacttttgatgtttcaaggacccttgatcaaggtgccactacccttttccacaagtggcaaactattgctcccaaacttcctaaagaacttttcttgcacactgttgtgggagttaccaattcagcttctgaagaaggtggaaaaactgtggtggtttccttctcgggattgtatcttgggacaccagagaatctccttcctttgatgcaaaacagttttgcagaattaggtttgcggcgcgacaacttcaccgagatgacttggattcaatctgttctttactttgcaggcttttcaaaagatgagtccttggaggtcttgcttaggagaaatcaaacatctccatctttcaaagcaaaatctgattatgtgaaggaaccaattccgttgcatggcttagaagggctatggaagatgctactcttggagaacccaccaccgtttatcttcacaccatatggtggaataatgagtgagatttcagaatcagaaactccgtttccacacagaaaagggaacttatatggtatccagtattcggtgaatttggtttctaatgaagaagcgccaaagcatatagaatggttgagaagactgcatgcatatttggcgccgtatgtgtcaaagtttccaagacaagcatacctaaattatagagaccttgatttgggtgtgaacagagggaactcgagctatgaaaatggaaaatcttggggtttgaaatatttcaattgcaattttgaaaggctggcacgagtgaaggcagaagttgatcctggaaattttttcagggatgagcagagcattcctccattg

SEQ ID NO: 3902 - DNA, 468 bp, Glycine Max
gtaaagatgcatcagtggacttaccaatccgacgttcctttcacatcaaacatcacaagccatctttggcagagagaagtagcaagcttgcggcaacaagtgcagtacatgcaagaatgtcacaggcaaatgatgggccaagagctttctggattgggtatcgaagagttaggaaatctggaaaagcgactggagatgagtttaaagggtgttcgcatgaagaaggatcaaattctgattgatgaggtcaaagaactacaccaaaagggaagccttgctcatcaagaaaatgtagaacttaatagaaagataaatctcatccgcaaggaaaatgaagaactacaaaaggttattgaagctaagtgtagaaaaggtgttgcagcatccaatcctccattcactatcaactatggatgtaatatgcttgctcctatcagtctccagctaagcctgccagagtcaacgtag

SEQ ID NO: 3903 - DNA, 375 bp, Glycine Max
gtaaccttccctacctcgaatttctttccatcatcagcacccccaacatcgttggcacaataccctccaccatcaccaaactcaccaagcttcgtgatctctatatcagattcaccaatctctccggccatatgccccatttcttgtcccaaatcaaaaccctcaaagtcatcgacctctcaaacaattgcaacgaactctccggcaacctccctgcctggctcccttctctccccaacttctccgaaatctccttcgacgcaaaccgcatctccggctccttctcgaagtcgctcacaggatgatgtcgctcaccgacaaccgcctcaccgggaagattccggcgaaactggcgaagctggacttgaagtttgt

SEQ ID NO: 3904 - DNA, 360 bp, Glycine Max; identical to SEQ ID NO: 589

SEQ ID NO: 3905 - DNA, 386 bp, Glycine Max; identical to SEQ ID NO: 590

SEQ ID NO: 3906 - DNA, 1119 bp, Glycine Max; identical to SEQ ID NO: 591

SEQ ID NO: 3907 - DNA, 1049 bp, Glycine Max
gtctacgaaaatgtagtctacaaggaggtattcctgattccagttcaatacccaagctttcctatttgtatgtttgagtatatttgttggctttgctttatattgtgcctaatgatagagaaatcatttttttctgccattttggctacaaactcatttgtgactggttcatgttttctagagatcttagctggaatcaaatcactagacccatatcatcaaataaagtgtatggtcagggagaaattaaatgcacacattgatacaattctatttgagacacagttgaaggtgggtaagaatgatgattgcatcccccataacagaaggtggaattttaataagaaggtattgcattatttttatgatgttatatttcttttttatagacacttctacaagcatcacatattgattattaggttgttgtcaacttttttggagctgatcagatgtggaatgagcaagggcattaacatcgaacgaccatatactttgatagaggaggaaccacagttgagaaaatctaaccctgttgcatgggttgaaagaatgtttgacctgcttgcatcaaaactgaatagagaaccaaagttgattctttgtgcaaatgtttctagggccttggaaaaagaagttacatttgcccctgtcaagatcactgatcaataccttaccaatgtacttcttaaaatcaattctaagcattatgggcatcttcccttgattaaagatacctcaacgatgattttggggatggatgtctcactattcacttgcatatcattcggttgtatgatgttggattgtatagaacgtctccgagaatgcaaacatcctctatacaagccattggaaaatgggagtgatgatagtattatcagaagggccagtggatataaaatagagatgctactgagctggctgaagttcgttagcaatagcataatttctatgattctagtaatggatgcaagtcaactcaatttattgttgtactgtccaaggtccacaaatgacgtggttgacaacctggccttagaggacac

SEQ ID NO: 3908 - DNA, 3450 bp, Glycine Max
gtctctgctgcttcttcttcatcagaggagaattccaatccatcagatgcagtgatcttctttggtctgagtttggctctggggattgcttgtaggcacctcttgcgtgggaccagagtcccttatactgttgccttactcattcttggcattgcacttggatccatagaatatggtactcatcatcggctgggaaagattggggatggaattcgtatttggtcagagattgatccagatcttcttttagctgtttttcttcctgctctcctttttgagagctcattcttaatggaagttcaccaaattaagaggtgtcttgcacaaatgatcttactagctggccctggtgttgcgctttctactgtttgtctaggagttgttttaaagcttacttttccgtacaactggagttggaaaacatcactgttgcttggaggacttctgagtgctactgatcctgttgctgttgtggctttgttgaaagatcttggtgccagcaaaaagctaagcacgataattgaaggggaatccttgatgaatgatgggactgctattgtggtttatactcttttctatcggatggttcttggagagaccttcaattgggttgctataatcaaatttctagcacaagtctcacttggagctgtaggaatgggtcttgcttttgggattgcatctgttttgtggcttgggtttatttttaatgatacagtgattgagattgctctaacatttgctgttagctacattgcttatttcactgctcaggagggttcaggtgtttctggtgtcttgacggtgatgtctttgggaatgttctattctgcatttgcaagaacagcttttaagggtgaaagtcaacaaagcttacatcacttttgggaaatgatcgcttatattgctaataccttaattttcattttgagtggagttgttatagctgaaggaatacttggtgacgaaaatgttttctatcatggaacatcatggacccacctcttgcttctctatgcatatgttcaagtgtcccggtgcattgtagtcggagcattatttccctttctaagatattttggatatggtttggattggaaagaagctattattctcatctggtcaggactgcgaggcgcagttgccttggcactttccttatcagttaaggcaatgctccttattgatataattcttcccggacattgtaccttatcattgtttacaagtgagataggtgctcgttcgggtggcaaatcatctgaattgactccagagacaggaacactgtttgttttcttcactggtggaactgtgtttttaacacttataataaatggttcaaccacacaattcattttacactaccttggcatggataaattgtcagctgctaagagacggatccttaacttcacaaagtatgaaatgttgaacaaggcattggaggcttttggtgaacttggagatgatgaggagcttgggcctgctgactggcctacagtgaagagatatatctcctgtttaaatgacattgaaggtgaatgtgttcaccctcatggagcacctgaaaatgatagtaacctagatcctatgaatttgaaagacatacgagtacgccttctgaatggtgtacaagctgcttactgggagatgcttgatgaaggaagaatttctcaaacaacagctaatatcctaatgctatctgtcgaggaagcagtagatttggcttcatctgagcctctatgtgactggaaaggtttaaaatctaacgtccatttcccgaattactataaatttctacagtccagtatgttcccaccgaagttagttacgtatttcaccgtggaaaggttggaatctgcatgttatatttgtgctgcatttcttcgagctcacagaattgcccgacaacaattacatgacttcataggagacagtgatattgcttctgctgtcatcaatgaaagtgttgtggaaggagaagaagcacggaagttcctagaagatgttaatgttacataccctcaggttttgcgtgttgtaaaaacaaggcaagcaacatatgcagtgctaaatcatttaattgaatatgttgaaaaccttgagaaggctgggatattggaagagaaagagatgctacaactccatgatgctgttcagactgatttaaagaaactactaagaaatcctcctttggttaagcttcctaaaataagtagtatccatccaatgttgggtgctctcccatcttcagttcgtgaatcacttgcaagttgtaccaaggaaatgatgaaattgcgtggtttgacactgtacaaggaaggtgccaaatcaaatggtatttggttaatttctaatggagtggtgaagtgggaaagcaagatgataagaaccaagcactcttttaatcctacatttacgcatgggagcacattgggtatttatgaagtgttgactggaagatcatatatctgtgatgtcgtcactgattccgtggtattctgcatttttcttgaagctgataagataagatcatgtctcaaagcagatcctttgacggaaaaattcctgtgggaggaaagtgctattttcctttccaaattattgcttcctcagatatttgagaaactgggtatgcaagatttaagaactcttattgcggattccgagagatctcgaatgaccatattcataagaggggaaacaatagaaattcctcatcattcagttgccctcttactagaaggatatgtcaaaactcaaggtcgtcaagaactggtaacagcaccagcagccctgcttccttcacatgggaatctaagcttccaaaatttggcaagttcaggttctaaggaagctagttttattcatcaacaaggatctagttatctagttgaaactacagcaagagtaattctgtttgacattccagcacctgaggctgatgctgctcttgttagaaggtcaagttcactgttatcacatgccggggatcatcctcatagatctttccgtcgaaaacatagtggtcttatgagttggcctgaacatttctacaaacaagaccataagcagagatctgaaggagctgggcgacaaaccaatagtttatctgcaagggcaatgcagctgagcatttatgggagcatgatgtttttcataaacgtagaaaatcaaatccctgaccatacacttaagagacaatgttatttgtcaagcatgccacaccatattggtgtgtgtcgtcctcttgtttcagtcaaatcagaaggagctgcaactgccaagaaggtccatgaggtcacaagacatgttacaaatccaccttcacaaagcacagaacgaagacagcatcaccatggagataattcaagtgatgattctggtgctgaagaagaagatattattgtgaggattgactcaccaagcacgctatcttttcgctag

SEQ ID NO: 3909 - DNA, 183 bp, Glycine Max
gtgcctagtttcccaagaggacaatatgtgaattaccgggatcttgacttgggaataaatacccaaaacagcacaagctacattcaggcaagtgcttggagctataggtatttcaagaacaattttgataggttggttaagattaagaccaaagtggatcctcaaaattgtcttcaggcatga

SEQ ID NO: 3910 - DNA, 2592 bp, Glycine Max
gtggagaaggaaaagcttcaggaagaatctgtaatccgccgcttctaccagattattcttagttgggactactttgctctcctcaaggaatctaaggcaaattcacttctttcccttactctttttcctttcttgaagctgaaaaacaaggagaagaaagggactgcggtgtcgacactcgtgaaggtgaagcaacgctacaaagatgttgatgattacattgccacatacgaacccctcgtctttgaagaagccaaatcccagatcattaaggagaaagaggaggaagaggtgactgaatggaaattgggggtggtaaaaagttggagcgaggcggacgattttcactttatagaatttccgtgtgaaatcaatgagggagaatcaatatcacagaatgatcttttgctgctttcgaaagagaagtttttggatgacaaaagattacctactgtttatgcatttgccttggtggaacatgtgcggaaattttttgaaacaaggcttcttcgagttagactctatcttgccggagagttctcaaattttaatacagataatgtacaatcttgccccagactttttatcttgagcagtgcaattagatgtagactttacatgtcagggtgcttggagtttcacttgataaaatcaggctacaaatggcaaaaagaacatattgatttcaaatacattcttttattcttggcagttgcttccattgacaatgtgtgtctgtgcagcttatctaccattgctcgtgagtatttggctgtacgaactataagctgtctcccatacaaggatttaatattaaatgcagttggagagaattttggcacagaagccgagggttggaaaatcccaatccctttgaaggaatatgttgaaagtactttcaatcagtaccaacgtgaggccataacagctggtctatcatcaaaagcctttgtcttgatacaggggcccccagggactgggaagactcagaccatacttgggattctaagtaccattttgcatgctactcctacaagaatgcattcaaagacctatgagctaaggcagggaccacaattacctattgaggagaaacaaaggcattgggcactagcgtctccatggcttaatggtattaatccaagggatagtttgatgccgaaagatggcaatgatggtttttttccaaccactggaaatgaactaaaacctgaagctataacttcaaatcgcaagtatcgtgtaagagtgttagtatgcgccccatcaaactctgcccttgatgagattgtgttgagggttttcaatggaggtatacatgatgaaaatgaccatgtttattgccctaaaattgtgcggattggtctcaaagcacatcattctatcaaggctgtttccctggatgaacttatgaaacaaaaacgttccagtgccaacaaatcatctaccaataaacagagtaacaacggtcccgcaggaagtaatgatgatagtctccgggctgcaattttagatgaggccacaattgtcttctcaactctcagctttagtggttcccatgttttcagtaaactaaaccgcagctttgatgttgtgattatagatgaagcagcacaagctgtggagcctgcgactcttgttcctttagccaatcaatgcaaaaaagtttttctggttggcgatccagctcaactgccagctactgtaatttcagacgttgctaagaatcatggatatggcacaagcttatttgaaagattgaagcaggctggttatccagttaaaatgttgaagactcaatacagaatgcatcctgagataagaagctttccctccagggagttttatgaagactccttggaagatggggatgaggtaaaatcacgaacaatacgtgcatggcatgattaccgctgctttggccccttctgcttctttgacattcatgagggaaaagaggctcgaccacctgggagtggttcatggataaatgttgaagaagttgactttgttctatttttgtatcaaaaacttatttcactttatccgacactgaagtctggtaaccaagttgcaattatatcaccctatagtcaacaagtcaagctcttccaaaaacgttttgaagagacctttggaatgtcagctgagaaagtagtggatatatgtactgttgatggttgccagggacgggaaaaggacattgcaatattttcatgtgtcagggcgagcaaagataaaggtatagggtttgtggaggatatccggcgaatgaatgttgggatcactagagcaaagtctgctgtgttggtggttggatctgcctcaacattaaggaggagtgaacaatggaacaagctagtggaaagtgcagagaaaaggaacttacatggtccttttatctataatgtttacataaatattcatttgttggtttcacagccatattcctcattcttcagtgatgaaagtctgacatccatgcaaacaaaggtggctgaaccatcacaagtgactggacctgatgatatggacaatgacgatggagaaggcgacatcgacatgaatgatgcaggttttgacgacgattag

SEQ ID NO: 3911 - DNA, 213 bp, Glycine Max; identical to SEQ ID NO: 592

SEQ ID NO: 3912 - DNA, 205 bp, Glycine Max; identical to SEQ ID NO: 593

SEQ ID NO: 3913 - DNA, 1005 bp, Glycine Max; identical to SEQ ID NO: 594

SEQ ID NO: 3914 - DNA, 1197 bp, Glycine Max; identical to SEQ ID NO: 595

SEQ ID NO: 3915 - DNA, 546 bp, Glycine Max
gttgcatatgcttttgcaaatgtgctgtacaagctcgccataaatgatagaatgagcattagcgtagtcactacttaccttctcattttcggagcttttttctctctttctcttgctcttattttcgaaagaaagaacataccaaagttgacatggagggtgcttttgatgtcattcttttgcggtctattcggctttgagaagttaaatttgcaaaccgcagcagggagggtgaaggtgttgggaacaataattggaattagtgggtcaatggtgctgacatttttcaaagggccagaaataaacatttggaactttcacattaatctttggaataaaaatcaaaatggctacataggaacatcgcatgctgactgtgcaagagaatggctagaaaccttaggccttgtgctagacaatccaattcgatcatctcaaatgccttatagagacaacaaaacttcaatacctcctgcaaatcacaagaggcaaggaaaagaacatatcaataagttgccaatgaaaatgacactagcagtgggatga

SEQ ID NO: 3916 - DNA, 1254 bp, Glycine Max
gtttggaactcttccttcttcctctctctctggatagccgttaacaatctcattctctttctcactcttcccattccaccatgctgtctctctctcccaaacccttttgcagattgcatgaatgaatcgcataggagctgtttgccgcttcacagtgtggaggtagacgaggatcgcgctagtctagacactaatgagtcttctagaactacctcttatgatatcttgacagttgaggatgtttcgcctattgaaccggcaagggcgagatttttgcaaattgttgtggatcattttgttgaagaccgtgtgattgagatgccagattctgaggctgattgtgccggccaagacaaaatgagtaagaggaggacgagtgagatccagtatgaaggagacccaaatttcgccctgcctttgatgtatatggcgaatatgtatgaaagtttagttagtgatgtgaataataggcttgcttccttgaatggtattcgggagaagacaataggggtagcccttgaagctgccggtggtttgtatagaaaactggctaagaaatttcctaaaaagggaccatgtacatttaagagaagagaattggctacttctatggaaacgaggacaaggttcccagaactagttatacaagaagagaagcgtgttcgctttgtggtagttaatggattaagaattgttgaaaaacctaataatgtgccgattgatgatgctgagtggtttaagagattgacgggtcggagtgaagttgctatctcagccaatgattacaaattttactctccaagacacaagtataggcgtggtgcatcaatttcactttcaaatatccaagatatccctttgtgcttggtgtggatcttaggacatttttttcctccacaaaatcagcagcaaacaccgtgcaaacatcacttgcagtcattgccacatcaacctcagcttcatccagttctccagaacaatcaaactatgcaccaaagtcagcatgcagggccctattctcataaccctcaaagtggtccttcacacctacctgaaatttctcatgctcaccagccaatatcaatatctcaacacatgacttgcttacaaccactcactggtggcaatgttggaggacgcttgcacatgctgccaacaactcctgcaaagttttgtgatgaatgcggggctccatatctgagggaaacatccaagttctgctccgagtgcggttcgaagagattaggaacatag

SEQ ID NO: 3917 - DNA, 2547 bp, Glycine Max; identical to SEQ ID NO: 596

SEQ ID NO: 3918 - DNA, 1179 bp, Glycine Max; identical to SEQ ID NO: 597

SEQ ID NO: 3919 - DNA, 117 bp, Glycine Max
tatgaggaattgcggctagctcgacttatactttacaaggccattgtacacaccgttttggaacagaaggaaagggatcaatggtgggaggcattcatgcaaacatgtaggcaatga

SEQ ID NO: 3920 - DNA, 1977 bp, Glycine Max
tatggccttgaattcagtaacctctcctatagtatcataaagaagcagaaaaaggatggagtttggatcaacaaagaatcatatcttcttcatgatatctctggccaggcaattaaaggtgaagttatggcaatcatgggacctagtggtgctggcaagtccacctttcttgatgcattggccggtcgaattgcaaaagggagtctagaaggatcagttagaattgatggaaaaccagttactacaagctacatgaaaatggtgtcatcatatgtgatgcaagatgaccagctcttccctatgctgacagtttttgagacatttatgtttgcagctgaagttaggcttcctccttccatttccaggagtgaaaagaagaagagggtctatgagctccttgaccaattgggcttacagagtgctacacatacctatattggtgacgaagggagaagaggagtgtcaggaggggaacgacgaagggtgtctattggcatagacatcattcataagccatcacttctgttccttgacgaacctacttcaggccttgattctacaagtgcttacagtgttgtagaaaaggttaaagacatagctcgaggaggaagcattgtccttatgaccatacaccagccttcatttagaattcaaatgctcctggaccagatcaccgtccttgcaaggggaagactgatatacatgggaaaggcagatgaagttcaggctcacatgtcaagatttggaaggcctgtacctgatggagaaaacagtattgagtatctcctagatgttatcagtgaatatgatcaagcaacggttgggcttgatccccttgtccaattccaacgtgatggcctcaaacctcacccggcagccatgacgccgcctgattctgcggacgacgaagacgacgacgatgctgaggattttgataactcccttgaaaggaaaattctaccaagatttctcggccaaagatttctctgtctggctttaccatggggtagtaggaaccccactgcagtttccaaccaatattctgcagctccttttgtggttggccagtctatggactactccgcaacttcatatgaaggatttgagattgaggaatatgcaaacccatggttgcgtgaggttgcagtgctctcatggcgaacagcactcaatgtaattcgcaccccagaactcttcctctcccgtgagattgtgttagctgttatggcacttatcctgtccagcatttttggaaatctgagtcatccttttttcgaagacatcaataggctcctcaatttctacatctttgcagtgtgccttgttttcttttcttccaatgatgcagtcccatcttttatcatggagaggttcatcttcataagggagacttcacataatgcttaccgtgcttcttcatatgtcatttcttccctcattgtttacctcccattttttgccgttcaaggcttcacatttgctgtcataaccaaaaagatgctccacttgagaagcagcctattgtatttctggctaatactttatgcctcgcttattactaccaatgcatatgtgatgcttgttagtgcacttgtgcctagttacatcacagggtatgcagtagtcatagccacaacagcactcttctttttgacctgtggtttcttcctcaagcgaactcagatacccttttactggatgtggcttcactatatttctgcaatcaaatatccatttgaggcattgctcacaaatgaattcaataacctcaactgctacacaggaaatttagcagaattatcccatggaccattaggagacctgaagctcagcaaacaccataactccagtctgcccgctaactgtttattagggaaagatatcttgtcctcgatggatattacaatggataacatatggtatgacatcttaatcctgctagcttgggatgttctttacaggttcttcttctatttg

SEQ ID NO: 3921 - DNA, 364 bp, Glycine Max; identical to SEQ ID NO: 598

SEQ ID NO: 3922 - DNA, 1500 bp, Glycine Max
tcaaacttggaaacactaaaacctctgaaatttgatattttcagatacacaagcagatccaacataccttcccataaattttttgaatcagatcgaaacacacagactgttatagaggagtccgagtatgagtttgagagtgatcggcaaagatatgcaggactacagccaacaaagccaggtgaaaagcctagggtggttgttattggtacgggttgggccgcgtgccggttcctcaaagggatagacaccagaatttatgatgttgtgtgcatatcaccaaggaatcacatggtctttactcctttactagcttcaacttgtgttggaaccctggaattcagaactgttgctgagcctgtatccagaatacaggattcattagcaagggaccctaactcctacttctttctagcttcttgcactggcattgacacaggcaaacatgaaatctattgtgaggcagttaacaatggtggattgcctcaagagccttaccaattcaaagtcgcgtatgacaagcttgtaattgcatcaggatctgagcctttaacttttggtatcaagggagtaaaggaaaatgctttttttcttcgcgaagtgaaccatgctcaagaaataaggaagagacttctccttaatctgatgctttctgaaaatccaggcatatcggaagaagacaagaaacgccttctacactgtgtagttattggaggtggtcctaccggagtggaatttagtggtgaattgagtgatttcatcatgagagatgttcaggagcgctatactcatgtcaaagattacattcacgtcacactcattgaggcaaacgagatactgtcatcctttgatgttagcctacggcaatatgcaacaaagcacttaacaaagtccggggtccgtcttatgcgaggtgtggtgaaggaggtgcatcccaaaaagataattctgagtgatggaacagaggttccttatggcctcttggtttggtccacaggggttggtgcctctgagtttgtgaaaacactagatcttcctaagtctcaaggtggaagaattggtgtagatgattggctgcgtgttccctcagtggaagatgtatttgcccttggagattgtgctggttttcttgaacacactggaaggcctgtgcttccagctctagctcaggttgctgaaaggcagggaaagtttcttgtggagttgttcgacgaaatagggaatcagaatggaggcaaggcttattctgcgaaaggcatgccacttggagaaccttttgtatataagcatcttgggagcatggcatcagtaggtggctacaaagcactggttgatctacgacagtcaaaggattcaaagggattgtcacttgctggttttgttagctggatgatatggcgctctgcatatctgacacgtgtccttagctggaggaacaggttttacgtggcagtcaactgggccaccacattagtcttcggtagagacaacagcaggata

SEQ ID NO: 3923 - DNA, 561 bp, Glycine Max; identical to SEQ ID NO: 599

SEQ ID NO: 3924 - DNA, 1943 bp, Glycine Max
tcaagatttgaggctactactttggagatagaagaaacatgtagtgctccaaaaccaaaagggaccaaaggaggagaaacttcaggtagttggaataataatgagagagaagagatgggtatgtgcttgacatggaaggatgtatgggtgactgcttctgtgggaaagaatgagatgagcaaatcaattcttgagggtctaactggttatgccaagccagggcaactcttggccataatgggtccttctggctgtggaaaatctgcacttcttgataccttagcagggagactaggttccaacacaaggcaaacgggggagattctgatcaacgggaggaaacaagcactggcatatggaacctcagcatatgtcacacaagatgatacattactgacaaccttaactgttggagaagcagtgcactattcagcccaactccaattaccagataccatgtccaaagaagagaagaaagagagagcagatttcacaatcagagaaatgggtcttcaagatgccattaacacaagaattggagggtggggtgttaaaggaatcagtgggggccagaagaggagagtgagcatttgcattgagattctaacacgaccaggacttctcttccttgatgaaccaactagtggacttgatagtgcagcttcctattatgtcatgaaaagaattgctacccttgataaaaaagatgatgttcacagaactgttattgcctcaatccatcaacctagtagtgaagtttttcaacttttcgacaacctttgtcttctgtcttcaggtagaactgtttactttggacctgcttccgctgcaaaagagttttttgcttcaaatgattttccttgtcctcctctcatgaatccatctgatcatttactgaaaaccataaacaaggattttgatcaggacactgagttgaatttacaaggaacagaaacaatacccaccgaagaagcaattcgcatccttgtaaattcatacaagtcatctgaaatgaaccaagaagttcagaaacaagtggcaatactaactgaaaagagcaccagttcaacaaacaagagaaggcatgctggcttccttaatcagtgctttgctctaaccaaaagatcttgcgttaacatgtatcgtgatctaggctattactggtttcgccttgccatttatattgcattggctataagtttagccactattttctgtgatctgggttcaagttatcgctcaattcaggaaagaggttcatttcttatgtttgtgtcttcattcatgactttcatgaccattggtggattcccttcctttgtggaggatatgaaggtgtttgaacgagaaagactaaatggacattatagtgtcacagcatttgtcattgggaacaccttttcatcaatcccatacttgttgttggtttcaatcattcctggggttatagcatatttcctacctggtcttcagaaagactttgagcactttgtatacttcatttgtgttctctttgcttgtctgatgttagtagagggccttatgatgatagttgcaagcattgtccccaactttctaacgggtatcataaccggtgctggaattcaaggaatcatgattttaggtgctgggttctttaggttaccaaatgatcttcctaagccattttggaaataccctatgttctatattgcattccatagatatgtctatcaaggaatgttcaaaaacgagtttgaaggactaagatttgctacgaataatgttggcggtggctacattagtggtgaagagattctaagagatgtgtggcaagtgaacacgagttactcaaaatgggttgatcttggaatcgtgctagggatgattattgtgtatcgtgttctctttttgattaacatcaaaactactgagaagctaaagccaatcattgtatcattcat

SEQ ID NO: 3925 - DNA, 1123 bp, Glycine Max
tcatctgggagtggtgatctctgcaagagttctacctcaggatcactgaattcaaacaatcataatggttccaattctgatatttcatatgactattcaagtatgcaggaccaattagacaatgtggatttgcctcctggggtggaggcatcactgccttggttgaaggacatttcttcttgtgaatgcaagcaggctgttgctttttcccgtacagaatctagttccaaggcaaaagtggatgaaactgaagatattgtcctgcaaaagtttcgacagtttaagcaatttgatactgttgactcttttcccgatcatcactatgataaggaggaaactaaagatgcacagaagcctaaaaattgggccaaaaagatccaggaggaatggaaaattttagaggaaaatctgccagagacaatctttgtgagagttagtgaatcaaggatggagcttctaagggctgttataattggacctcaaggcaccccataccatgatggtcttttctttttcgattgcctctttccttctacctaccctgcaggtccaccgaaagttcactaccattcaggtggcctaaggctaaatccaaatttatataattgtggaaaagtctgccttagtctcttgggcacttggcatggtagtaatagtgaaaattggataccagaaaaatcaaccatgctacaagtgttgactagaacaatacatgattctgtaatcgttggaaatagtgaaaacaaaacaataaaaagttgtatttactgtttcatatacaaggtacaaacatataaaaacagcatacaaagaaaactaaatatctgtttcaagattttagatgtcatgatactaggagttgctactttgatgaataaacaggaaatgcagagtacttgtggattatcaccctccaacttatttaacatttccttcatgtgcagcactttgaggagctggttgcgggacatttccggggctccggtcgggtcggttctacataatctagctccaagttgtggcaatagttctacggctaacgcccagaaagaattcgagtcagctgtgagtaggatgatgaatactatgattgcatttttcaccaagaatggctccacagact

SEQ ID NO: 3926 - DNA, 233 bp, Glycine Max
tccacccccacaactaccgtggcaacgaaatctatggtctcaacatgccgctgttgttgtttggtgacaaaactgatgaggaaactcaagagacgtaaccgcaaactgcgaccaaaaagtgcaagtcgacagggttcattccaatgccgctatgatcctttgagctattccttgaactttgacaccactggaatggatgaagattactacaagttctgtgctttttcttcaag

SEQ ID NO: 3927 - DNA, 603 bp, Glycine Max; identical to SEQ ID NO: 600

SEQ ID NO: 3928 - DNA, 333 bp, Glycine Max
tcctttgtggttctagcagacatgcacgaaatagaggatgagctgcacaaactggaggtggagaatcgtaaaagggaaatagaggaaaaggaggataagaaacctagtcatccacttgatgattctattgagctctttctcaatacttccctgagttggttttttaactcacatgatagtgaatttcgtgttgcatctcttccttacatgctagagtttaaggttatgcctgaggggtgcgatggcattaacgaagatgtggatgatgggcattacgacatacacaaaatggaggatgaaatgctttatcgagagtttgtcgagaaacttcaa

SEQ ID NO: 3929 - DNA, 423 bp, Glycine Max
tcgtggatatcatctggtgctgttgtgcttaagacgagatctccatggaagaggattatgagtgctgagaacaatattagggtttgtgggaacatgtcttccctcggactcagacgcttcctagctgtcaaggattggatcaggatcatatactataagttgctagtactaagagaagttttaagaaaagaaattagcacatcaatagaagtattgagttatattaaaactttagatttttttccaaatgtttacattgcatatataattttattgacaatccctgtaacaattgctactgctgagagaaatagattgaatgaattagctattttatctattgaaagtgaagtgttagaattgcttgattataaaactttgataaatgatcttgcagctaaaaaagctagaagattaatataa

SEQ ID NO: 3930 - DNA, 702 bp, Glycine Max; identical to SEQ ID NO: 601

SEQ ID NO: 3931 - DNA, 885 bp, Glycine Max
tctaatgcaagctcaaaaccccttgtcattgtgacaccactagttgtttcccacgttcaagccaccataatctgttcccaacgccatggcatgcagatccgaaccagaagcggaggccacgattacgagggtctctcctacgttgccaaggttccatttgtggtcattaacctcataaaccttcgagaaatcaaagtggacgtgaaaaacaacactgcatgggttcaagctggagcaactattggtgaactttactacaagattagcgagaaaagcaaaacactagggttcccagcaggtgtgtggcccactatgggcactggtggccacttcagtggcggtggctatggattcttgatgcgtaagttcggtctcgctgctgataatgtattcgatgctcacataattaacccgaagggtaatctccttgatagagaagccatgggtgaggatctgttttgggtcattagaggaggtggaggaccaggttttggaatcatcgtggcttggaagataaaactagttccagttccatctactgtgacaaatgcaacagatattattcataagtggcagcttgtggcaaataaacttgacaatggcctaatgattagggtcaacgagtgtgtatcaaatacatgcacctcattaagtagtatttatgaagtacccaggaatacaaataaaagttggggatctcgtagactaagcacgcagcttacctatgccagtcattcatttgagaacaggaagatagactttcattggatgtatgtgggagcactaggagggaatggaaagaattccaagatactaataaagaaactattagaatttggaaatgtaagtctagaaacttgtttttccacaaagtttggtctatag

SEQ ID NO: 3932 - DNA, 528 bp, Glycine Max
tctcaaaccggaactgatggaagccttgtatctgaagagggttccacacacaaagcatcagacccttttgatattggaggtggacacgtggaccccaacaaagcaatggatccaggactcatatatgatatcaccactgaggattatgtccaattcctatgttccatggatcacagtagtgcatccattagcaaagtgactaagaccaccacaagttgtaagaaaggaaatcaccaagcactgaacctcaaccttccttccatatcagtgccaaacctgaagagggctgcaacagtaatgagaacagtgacaaacgtgggaaatattactgcagtctacaaagctctagtgaaagttccacatggcataaaagttagagttgaacctcaaactttgagtttcaattcagatgtacgaatccttaactttagtgtcagttttctgtcaactcaaaaatttcatggagattacaaatttgggagcctaacatggacagatggcaagtattttgtgaggaccccaatagct

SEQ ID NO: 3933 - DNA, 1260 bp, Glycine Max
tctccaacaaacccagaacagcattatgatgatcttacgaggagggagagggaggcgaaaacaaaaaccttggttaaccttgttaaccaccttaccatcctgccccaccgaaaccccacccggcctcacatcctgaggcggacccccctggtactgcggcggcgcgtgcaccactcctccctgcgcagtatagtaaacctgtctcccactcgcgctatcatacgccacctgcgcatacgccgcattatccggcaaccccgccggcctcaccacgccgccactatatccctccgaatacgccggccccttaaccatccccgccgtcgaaaaccccgctttcggcgcagccatgcctccgtacaccgcctgctgttcacggtagccatcagaacccatcctctgcacagcgtagtatccctgcgccgccgccggaggtcgcatcaccggcgagtggtgatagaacgtccccggcgccgccataacatacatcggctggtcacctcctcccggagccgccgtcgtcaccgtcgtctgatatccctccccggaaaactgcttctccgaccagtacgccgccggaggcggcaccgccgcattctgcggcggaaccttctcctgcaccttctgcatgtaataatctcctccggctgcagcagcataaccagttgcaaatccatcctcactccttctacgatattcattctccgcaatctgcaatcgctgcatctcctgctgcatctgtctctgaatttccatcgaattcacattcggatccgatccaacaacccgatcggaaactctcgattgatactctaccggcgtcggagcgacaggttccggcaccggatcgtggaatttaaccgctgcgaagttcggaggaagatttggaggagcaacggctttatcgagaccgaagagataatcaacattagaaggcgtaacgggtggggttttgatcggatcgggttgagaaggaaccggacccgaattaagagcctcaacgaaacggtcgcttttggttctgctgctcgtcccacggcggcgggttctcgaagtcgatctcgcgcgagcgcggggaggactcgccggagtcagggtacgacgccgggtactgatagttctccatttttttctgtcagatatgtggaaatgagaaagagtgaggacccttcaccttttgtgagtgtgaggaggggtttattttttattttttatttttgggatttattactttttaatttaatggttatttacagttag

SEQ ID NO: 3934 - DNA, 279 bp, Glycine Max; identical to SEQ ID NO: 602

SEQ ID NO: 3935 - DNA, 962 bp, Glycine Max; identical to SEQ ID NO: 603

SEQ ID NO: 3936 - DNA, 1058 bp, Glycine Max; identical to SEQ ID NO: 604

SEQ ID NO: 3937 - DNA, 3207 bp, Glycine Max
tgggttgacagtcaccaccactgcaactggtctggcattgcatgtgatccatcttcaagtcatgtcatttcaatttccctggttagtcttcagctccaaggggagatttcacctttccttggaaacatttcaggccttcaggttcttgatttaacttcaaactcattcactggctacattcctgctcagctcagtttttgcactcatctttctacactatctctttttgaaaattctctctcaggtcctattcctcctgaattaggaaatcttaaaagcctgcagtatttggatttaggtaacaatttcttgaatggaagcctccctgacagcatattcaactgcacttctttgttgggaattgcttttactttcaacaaccttactggcagaatcccatcaaacattgggaatctagttaatgctacacagattttaggttatggaaataacttggtagggtctatacctctttccataggtcagttagtagctttgcgagctcttgattttagccagaacaagttatcaggtgtaatacctcgagagattggaaatctgacaaatttagaataccttctattgttccaaaattccttgagtgggaaaatcccttccgagattgctaagtgtagcaagcttttaaaccttgagttttatgaaaatcagtttattggaagtattcctcctgagctaggaaatttagttcggttggagactctgaggttatatcacaataatttgaattccaccattccatcttccattttccagttgaaatcgttaacacatttaggactctcagagaatatattggagggaacaatatcttctgagattggatctctgagttccttacagatcccttcatcaataacaaacttgacaaacttgacatatctgtcaatgagccagaatctcctttcaggtgaacttcctccaaacttgggtgtgcttcataatttgaacattaccaatattactagtcttgtaaatgtaagtttgtcttttaatgctttaactgggaaaattcctgagggtttttcaaggtcgcctaatcttactttcctgtctcttacatccaacaaaatgactggggaaatcccagatgacctctataactgctcaaatcttagcactctaagtttggcaatgaacaacttcagtggattgataaaatcaggtatccagaacctgtctaaactcatacgcctgcagctgaatgcaaattctttcataggaccaattccaccagagattggaaacttgaatcaactcgtcactttatccctttcagaaaataggttttcaggtcaaattcctccagaactgtccaaactttctcaccttcaggggctctctctatatgcaaatgtattagaaggtccaatacctgataagctctctgaattaaaagaactaactgaacttatgctgcatcaaaacaagttggttggtcaaatacccgattctctctcaaagcttgagatgctttcattcttagaccttcacggcaacaaacttgatgggtccattccaagaagcatggggaagcttaatcagcttttatcattggatctctctcacaaccagctcacaggatcaattcccagagatgtcattgcacacttcaaagacatgcagatgtatcttaacctttcttacaaccacttggttggaagtgttccaactgagttgggcatgttgggaatgatacaagctattgatatttcaaacaataatctttcaggtttcattcccaaaacacttgctggatgcagaaatctgttcaatcttgatttttcaggaaacaatatttcaggtcctattcctgcagaagcttttagtcacatggacttgcttgaaaacttaaacctctcaagaaatcatctagaaggtgaaatccctgaaatattagcagaacttgatcatcttagttccctagatctttctcagaatgacttgaagggaactattcctgagcgctttgccaacctttccaacttggtgcatctcaacctttccttcaatcaacttgaaggtcctgtacccaattccggaatttttgcacacatcaatgcatctagtatggtaggaaaccaggatctttgtggagctaagttcctatcacaatgcagagagacaaaacattcactatccaagaagagcatatctattattgcttcacttggatcacttgctatactgctattactagtgttggtgattctaattctcaatagaggtatcaaactctgcaattctaaagaaagggatattagtgcgaatcatggaccagaatacagttcagcattgccacttaaaaggttcaatccaaaggagttggagattgccactggttttttcagtgcagacagcatcattggttctagcagtttgagcacagtttacaaaggtcaaatggaagatggccaggttgtagccataaaaagattgaatctgcaacaattctctgcaaatactgacaagatcttcaagagagaagccaacaccttgagccagatgagacataggaatttggtcaaggtacttggatatgcctgggagagtgggaaaatgaaggctttggttctagagtacatggagaatgggaatttggatagcatcatacacggcaaaggggtagatcagtctgtgacctctaggtggacattatctgaaagagtccgagttttcatttctattgctagtgcattggattatttgcactctggttatgattttcccattgtgcactgtgatttaaagccttctaacattcttttagacagagagtgggaagctcatgtcagtgactttgggacagcacgaatacttggtcttcatgagcaggctggtagtaccctttcctcatcagcagctttgcaaggcacagttggctatatggcaccagaatttgcctacatgaggaaagtaacaactgaagcggatgtgttcagctttggtatcatagtaatggagtttctaacaaaaagaaggccgacaggactctcagaagaggatggtttgccaatcactttgcatgaagtggtgacaaaagcccttgcaaatggaatagaacaacttgttgatatcgtggaccctttgttgacttggaatgttacaaaaaatcatgatgaagtgttggcagagctctttaagctatccctgtgctgcaccctccctgatcctgaacatcgacccaat

SEQ ID NO: 3938 - DNA, 99 bp, Glycine Max
tgtgtaaaaattaaagattatttgaacatttttccaattgtaattgaaaacaaaacaaaaaatcattcaaagccatgttcccttttatgtgttgtttaa

SEQ ID NO: 3939 - DNA, 2333 bp, Glycine Max
tgttatgaggtatctgtgcttaatcctagtcgaatctggcaaactgataacgtcctaaaatcggagctccctattctcgcctttcaaattgtcttcactgttgcattgtctcgtcttttcttctttatctataaacctctccatcaacctcgtcttatttcacaaatctctgttggtttcctactaactccaccgttacttgggagatatacagcaatttttgagttcatatttcctgtaaatggggttcttaatgtcgaagtcctttcacacattggcctgatctactatgcattcctcagtggtttggaagtgaacttagataccattctacaagtaaaaaagaagcctgcaagcatcgcggctgccgggatcatctttcccatggtgatggcaccaggcttgtatgctctacatcgaaaattttacgacaataaggcggcaaatcagcttgaagaaagtacaagtaatgcttatttactttggactttagttcttactgttacaggttttcctgtcgtagctcacacactttctgagctcaaactcctttataccggtcttggcaaagccgccttaacagcagccatgatcagtgaaacctatggttggattcttttcactttactggttccattttcaattaatggtaaaatagctgtctactcggtgttaagcactatattattcattgttgtctgcatctttgtgttacgtcccatctttctccgacttattgatcgcaagacagacaaggaggagttggatgataagcagtcactctttgtgcttatgggggttttagcttgttcatacattacagatattctaggcacacatggcattgttggggcttttgtatacggattaattttgcctcatgggagatttgctgagtttatcatgtcaatttctgatgattttgcttgtgggtttctagcaccgctcttctttagtggcaatggaatgagacttatgttgaccagcattttttaccaggcccattggcccttaacactgctgattgtactcttgttgtgtgttccaaaaattttaagcactttatttgccactttcttctttggtatgcgcactcgagatggtttagctttaggcttgcttctgaatacgaagggcgccatggcactaataatgctaaacattgcttgggatcgagcgattgtttctataccaacctatgccgttattacttctgctgttcttttaatgactgtagtagtgtctcctatcatcaacgccatctacaaaccaagaaagagatttgagcagaacaaactaaagactatacaaaaactaagacttgatgcagagcttcgaattcaagcatgtgtccacaatactcgccaagccacaggcatgatcagcataatcgaatcttttaatgccaccagactttcccctatacacgtttttgccctgtaccttactgaacttactggacgtgctgttgcccttcttgctgcacatatggagaagcctagtagccaacccggagtacaaaatctcaccaaatcagaggcagagttacaaagcattgccaatgcctttgatgcatttggagaggcacatgacgctgtcagacttgagaccttaaatgtggtgtcagcctatgcaaccattcatgaggacatacacaactctgcaaatgagaaacgcacaagcttaatcctccttcccttccacaaacaattaagttcagaaggtgcgcttgaagtaaccagtgttgtatacaaagatataaaccaaaatgtaatgcaacatgcaccttgctctgtgggaatctttgttgatcgtgattttgggtcaattcccaaaatgaaccttcgtattcttatgccctttgttgggggacctgatgaccgtgaagctttggctattgcgtggaggatggcaggacatccaggaattcacctatcagtggttcgaattattttgtttgatgaagcaacagaagtagatacttcaattgaagctgaagcacaaggaatattatctactgtagtggatagtgagaagcagaaagagttagatgacgagtatataagttcatttagacttacggcagtgaacaatgatgattctataaccttctcagagattgatgcccatgctgatgaagatatccccgcaatccttaatgagctagaaaaaaatggttgtgatttatacatagttggacaagggaattgtaggaattctcgggtcttctcaaatttgttaaaatggtgtgattgtccagaactaggagttataggggatattttggcatcaaatgattttggttcgcgctcatctttgctagttgttcaaca

SEQ ID NO: 3940 - DNA, 1802 bp, Glycine Max
ttaacagaaatcagtgaaagtgttcaaagagaggacataacagggacatgggagaatttgtgggtcactgtttcaagtgggaagaacaagaagccaattctgcaggatcttacgggttatgcacggccaggaaggattcttgccataatgggcccttcaggatgtggaaaatctacacttcttgatgctttagcaggaagattgagctcaaacatgaagcaaacagggaagattctaatcaatggccagaagcaagcactggcctatggcacatcaggctatgtaactcaagatgatgctatgctgtcaactttaaccactggagaaactttatactactcagctcagctccagtttccagattccatgtccatagcagagaagaaggaacgcacagatatgacattgagagaaatgggtctgcaagatgccatcaacacaagggttggagggtggggttctaaaggcctcagtgggggacaaaagaggagacttagcatttgcattgagattctaacacgcccgagacttctcttccttgatgaaccaactagtggacttgacagtgcagcttcatattatgtcatgagtagaattgcaactctaaatcaaagggacggaattcgaaggactattgttgcatccatccatcagcctagcagtgaaatttttgaacttttccatgatctttgtcttttgtcttctggtgaaacagtatattttggtccagcctctgatgcaaatcagttttttgcttcaaatggtttcccttgcccaactctccacaatccttctgatcactacttaaggatcataaacaaagattttgaacagactaaattaattgacggttatcaaaaaaaagcaattgatacccttgtaaagtcttacaagtcgtctcaaattagaaaacaagttaaaaaggaagtggataaaataggtgaaagtgattctgatgcaataaggaaccagaggattcatgctgcatttcccactcaatgccttgttcttataagaagagcttccttgcagttgtttcgtgacataagcaattactggttacgtttaattgtcttcattgtaatagctataagcatcggctctatcttctatgacataggcacaagtaatggatctattcaggggagaggttcgctgctcatattttttgtttcagttctgactttcatgacccttgttggtggattctctccacttttggaagaaatgaaggtatttgaacgagagagattgaatgggcactatggcgtcacggcatttctcataggcaacatattctctgctgttccttacatgctattgatctctcttattcctggtggaatagcatactacctttgtgggatgcacaaaggaccagaacggttcttctacttcacttctttgctatttgccatagtgatgtgggttgagagccttatgttggttgtagggagtatctgccccaattatgtaataggcatgttccttgctggtggagttgaaggactcatgatcttaacaggtggattctatagacttccaaatgatcttcccaaaccactatggaaataccctttatactatgtttccttcctcaagtatgcattccaaggatcattcaagaatgactttgaaggcttaacattttctgttgaccaagatggaggaggcatcatgagtggtagagaagtactaactgacacatggcatttggaaatgggttactctaagtgggttgatcttgctatcatgtttggaatgattgttctgtatcgagttttgttcttggtcatcactaa

SEQ ID NO: 3941 - DNA, 447 bp, Glycine Max
ttaaccttgttggaatttcggggaagaataacttctgatccttttgctgctctggcaaattggaatccaaatgattgcaacccttgcaaatggctgggtgtccgttgtgttgatggtcaagtgcaatcactggtcctacctgatctatctttggaagggacattggctcctgagcttgggaaacttagtcatctaaaatcccttgtactatacaagaacagtttttctggtaccattcccaaagaacttggagatctagacaagctggagttattggatttaagggggaatgacttgactggatgtatcccagcagaaattgccagggtgttgttgtcaaaaaacctgttggtttgtgacaataaatttgaaggcagtgattctcaagagctcagaaagctaaggttgccctctaataacaataacagaaagtttgtgcaccagtaa

SEQ ID NO: 3942 - DNA, 740 bp, Glycine Max
ttacaaaaagcaatcaaccctccaaatgctttgtctggtttcgaagattgcatcacaaggaagttgggaaatggccagaataccttatttggggaacattcatggtgtgatcggcaaccgctgtatagacaatatcaaaggctctatcaagtagccaacaacaaggaagccaaagtagcagaggttatccaaccaaacatcaatagaatttcttgcagatgggtttggcgcctccaattatttttgtgggaagaagagctattgctgcagccggaaagtgaacttcgctcaacattgcaattcagcattgatgaggatggttgggtatggaagccgagtgggaatcaatctactgtggcttctgcattcaaccatttacaagccaccgtgttggaagaggagcaccaggagatatgtcacattttaaagaaattttgggtcaatttagaaacgaggaatcacttatttctaagctgtgaaatcgcctctcagattttgaaggcaattttcaattggttaaatatttctggaaggacaaaaaacaaatgcagccatgtgatttggcatgcaaaaatgtggagcatttggaacgcaaaaaacaaacgcgcttttcgtcaacaagctgtcaaggttgctgaagtttttgagttcatacgctttattacatggcaatggctactatacaagcgtatgaaatgtcatttcatttccatatcaaattggtacttaaatccggttgt

SEQ ID NO: 3943 - DNA, 270 bp, Glycine Max
ttatatggtcacactcacatattaaattttgaacggaataatggaatctcatattcaaatctcttaaagattgtaagtgacacgcacgcgataagaaaatgttttacacttcacgttgtgaaaaaacatctgtctaagatggaaggagttacatcatttagtatagacgtagaatctaagagggtgacagtgatggggcacatttcaccagtggaagtccttgagagtatttcaaaggtgaaaagggcagagttctggactgcttgttaa

SEQ ID NO: 3944 - DNA, 1203 bp, Glycine Max
ttatgttgttgcatgagaataattgatgaaacaaatcaccaaatcgccatggctgttaacatttttgaggaaaatgtagaaagacttccccgtgttgctgctgttggggatgtaattgtgctttgttgtgttgagatattagataaacttatgtctttttactatgaattttttattttatcttttgtaggcaaagatggtgatgatttggatccttatcatgtttcttcttattttcaccacatacgtgaagatgagagcttaatagttaagcttagaaaatggctgatgaattttcagcctcacgaagattcatgtaatttccccatgttaagagaaatcaaggaagaaacttctgttaatttggcatgcaagatccttcatttttgtgaggctgctaaagatgagtggattatatttgcttgggatggtactaacactccaccaaatgtcatatgttcaaagcttgaagaagaaattaactctccacttcctctacaactagaacccttgcctttgtcaagagaggttttatgtactttgcccgttgttggatccatcttgaggatgacgtttgatgcagaccttgtgaaaaatcatttacaccttttaaatgttgataaatgggtcaagtttatgaatatgcgtcttaaggtggttgatggactatggctcggcgtttttacccctcaatcaaagcttcaatatacaccaaatgaggacggtctgattgttgaacgtcaaaggttgtctgaagagtggctattccctaagccttcatttattacagaagaagttaatcaagatcatgctatccctgttactttaatgactgtcctcactcattcagaggtggtgactgctaaattcaagtgtgttgttcgagtggtagcagcaacgccatgccaagctgaaaatctgttatctagtactggggaatatagaatgcggcttacactagaggattcaacagctagaattcatgcttttgtaactgccaaggatgggcttatcctttttctgttcatgataaatgacaggaggaagctaaacatattacttggagtaaatgaggtaaaggatgctccaagaaatccaccatgggtttgtgtttgtctcaagtcattttgtgtctccaaaactgatgtatggagcagtagaacctttaaaatatttgacaccaaaatagtgggagatacatga

SEQ ID NO: 3945 - DNA, 333 bp, Glycine Max; identical to SEQ ID NO: 605

SEQ ID NO: 3946 - DNA, 196 bp, Glycine Max
ttcaacctctcggcgccaacgtacggattcgacgaggcggtggaggtggaggaggcagtggtggcgaaggagattgggagggtggttagggttttgaggcaaaggttgccaattcaggattggttgatgaagatgaagattgcgaggaactgcttcgcggggagcgatttggtggagtttctcgttcgataccatg

SEQ ID NO: 3947 - DNA, 2232 bp, Glycine Max
ttcaaggaatgcacacatccaaatgaagtgcgacgccgtcaaataggcgaggagctcgggcttgatcctgaacaagtaaaattttggtttcaaaacaagaagacgcatataaggactataaatgagcgattagatacagatgctcttcggcttgagaatgaaaggatacaatcggaaaacaacaaaatgagagagactttggagaatctttcatgcggatcttgtgggggtcgagccatggaaccagtaaagcatcaactttccttgcaagttagtaaattattttgtaaaattcatttagaccaagcactacttcctgtccttccttcttcttcatcacatgatgccttaggaggaagtttactaaatcaaccagttggaattcctgctcataatcaattcatttctaaccatgataaccattatattcctgccgcaattccaactccttttcaggataatcctattgttagccctcctagccataatcaagacattaaccctgctcctaccattgatcaacacattcctactcttgatgatcccactctcattggagataattctcctttgatttcaagttttgattataatattccagctttggttactgctcttgatcgaaatcttcccgcaatgattcatcctcacgatcaaaataatagcattccttccgctgagaaagaaattcatcaattggatgcagttcaaattctaaacaatgatatgttaccccaaccaatgaagagcctaagtaaagatatggatagtgtacaaatgttgaagattgcagaagatgcaatggaagaattgatgaaacttctcagtttgaacgagcccttctggtttagatctttactagatgggaaattcaatcttcggcatgattgctacaaaaggatatttggtaggagcaattgcttaagtggacctcatgtacgaatggaatcgtcgaaagattcacgagttgtgaaaatgagtggggcacaactcgttgaaatgttcttaaattcggacaaatgggttgatctattcccaacaattgttaaaaaagctcaaacaattcaagtacttgaaagtggttcatcaggaaaccgaaatggagctctacagttggtgaatgcagaaatgcacattctttcacatttggttccgagtcgggaatttctcttccttcgttattgtaaacaaattgaagtaggtatatgggccataggggatgtgtcaattgattcttcaacatacaaaactactgtttctcacgctcgaaggcttccatctggatgcctgattcaagaaaagtcgtctgagggattgtgcatggtttcatggatggagcacgtggaagtgaatgaaaagatgcaaacccacaatcttttcagagatactatttgtgggaataacgcatatggagcagacagatgggttatgacccttgaaagaatgtgcgaaaggtttgcaagctactcagctaaaactatacctagttgtgagactggaggagttgttagatcgcccgacgtaaaaagaaacataatgcacctaacgcatcgtatggtgaaaatgttttgtgggaatttggacatgcaagacaatccaaatttcccaaatttaacccggatgaacaacaatggggttaagttatccattcgcgtgaatcacacagggccaaatgagcctaaaggcacgatcattggtgctgctatctgctttcgggttccactctctccacaaattgttttcgataacttgatagacaacaacaaacgagccaagtgggatactctatgcgatggaagtgcagggcacgagattcaacgaatctcaactggaagcaatcctggaaattgtatttcaatcatgcggcctttcatccctaaagagaacaatatggtgattctccaagaaagttatgtagatgctttgggatccatgttggtattcgctcctttttatatggaaggattggatttgatcatgaagggagaagactcatcactgtttccgattcttccctctggccttaccatatcttgggattaccaatcaaataaagttcctgaaggacaatctggacaagttggtcaatcaaggggttcgttggtgactctaatgtttcaacttttggcatccagtacatctaaaatagataatgtagacatgaaattaataggttctattaatacactcgtgacctcaactgtggagaaaattaaagatgctttgaattgc

SEQ ID NO: 3948 - DNA, 1101 bp, Glycine Max
ttcccatgctcttcatcattgcttttttgttgggtgcggtttccttttctaaaaggagaaaggctcaaatttattctcaggctcgcatgtatggaaggaaatctattgagggaagtctctcttaaatggatcttcctagtctctgactccggcccaggcaacccaatatgtgatttgacttgtgcagaatccatacacattgatgatcccggtggatctagtagtggatcagcaatatcagtggccgcaaatttggtggcagggtcccttggtagtgagactgatgggtccattttatgcccttcaggttctaactcagtagtgggcattaaaccaacagttggcctcactagtatagcaggggtagttccaatcaccccattacaagacacagttggaccaatttgcaggactgtattagatgctgctcttgttcttgaaaccattgcaggcatcgacatcaatgataaggcaacaatcaaagcatcaaagtatgttccaagagatggctatgctcaatttctaaagatagatggactgagaggaaagagattaggtgttgttagagcattctacgataaacaacattcaggaaatcttaatgatcaaagtgaagacattgctatggcatatgaattcaaattatccttgaacgcatacctcagacttagttgcttccccaatgagaagcttggccgatgtgatagccttcaacaagaaacacccaaaattggtatgtatgagaaacttaaggagtatggccaagatctcatgctggtagctcaaaagacaaatggagttagggaactgaaggaagcagtgctaaacatggcaagattgtcacatattggatttgagaaattaatgataacaaataaccttgacgcaatggtggtacctttttcattctttgctagtatacttgcaaggggaggttatcctggagtaactgttccagcgggatatgaaaagggtgcaccatttggaattatctttggaggtttgaaaggctcggaaccaaagctcatccaaattgcttattcctttgagcaagcaactttgatcaggaagcccccaccactccgaaagttggaggtttaa

SEQ ID NO: 3949 - DNA, 1371 bp, Glycine Max
ttcctcctcgtgacctaccctgcccagagtcacataaaccctgccctccaactcgccaagcgtctcatcgccatgggcgcgcacgtcaccattctcctcactctccacgtttaccgccgcatctccaacaaacccaccatccccggcctctccttcctccccttctccgacggctacgacgccggcttcgacgccctccacgccaccgactcggacttctttctctacgagtcccaactcaaacaccgcacctccgacttactctccaatctcatcctctccagcgccagcgagggccgccctttcacttgcctgctctacaccctcctccttccctgggttgctgacgtggcgcgccaattctacctccccacggcgttgctctggatcgaacccgccacggttttggatattctttatcacttctttcacggctacgccgatttcatcaacgacgaaaccaaagagaacattgtgcttccgggattgtcgttttcgctttcgccacgcgacgttccgtcgtttttgttgctgtggaaaccgagtgtgttttcttttactctcccgtcgtttgagaatcagattaaacaacttgacctagaaaccaacccaacggtgcttgtgaacacctttgaagctttggaagaagaagcgttgagggccattgataagatcaacatgatccccatcgggccgttgattccttctgcgttcttggacgggaatgacccaactgatacttcgtttggtggggacatttttcaagtctcaaatgattacgttgaatggcttgactcaaaggaagaggattcggtggtttacgtttcatttggtagctactttgagctttctaagagacaaatggaggaaattgcacgtgggttattagattgtggacgtccatttttgtgggtcgttagagaaaaggtaattaatggaaaaaaagaagaggaggaggagctttgttgtttcagagaggaattggagaagtgggggaagatagtgacatggtgttctcaggtggaggttctttcgcattcttctgtgggttgttttttaacacactgtgggtggaattcgaccatggaaagccttgtttctggggttccaatggtggcgtttcctcagtggactgatcagatgaccaatgcgaagctcatagaagatgtgtggaagataggggtgagagtggatcatcacgtgaacgcaaatgggatagttgaaggaaaggaaattgaggcatgtttggatgtggtgatggggagtggtgacagagcaagtgaatttagaaagaatgctaagaaatggaaggttttggctagggatgctgcgaaagaaggtggctcttcagagaagaatctgagggcattt

SEQ ID NO: 3950 - DNA, 124 bp, Glycine Max; identical to SEQ ID NO: 606

SEQ ID NO: 3951 - DNA, 1314 bp, Glycine Max
ttgaattattatttgttaaattatttggttgatttgttgataggagagaaaaatgatatggaacaactgttactccagaaagaggtaagggggtttcaaccaggaagaaatatgagcatcttcttcagaaattcttcaaaaaggcatttgaggtattgtgtgtcgttatcttctttggttggggtggtagtctgggaggggttggttgcagcctatagtcatattacatgcaatgtaatttcttttactatgataaatagtttttggcttgccatcggactagtgggagtggggagggtttctgaacacaatactgttttgtgcttctttataactttagagggttggcgtaattttgcatttcaaatggaatggattcacatgatagggtcagctcatgtcatgatgaagcctcatcttgtcataaatctctgcatgactcaatctagtattctagtgatgaagttatttattttttcaggcttattacctcacaacagccagggaattagccagaatggcagggacttgaaaggcaccaatcttgcatcacttctcagaatcaatagttggggcttccacaatccactgtttcaatcaagagcaactattcttgatcaaagtggccttttacaattttggcagcttggaatggttgtctgtccgaatcaatttcctcttcaatatggtcttgtattttgttcttgtgccatcttcgttactttgccaaggtctaccattcaagattgcaggcctgaaccagagtggccaaaggagggaaaagttgaacttcataaccttcatatacagaatgaccctgctgctcctatggtcctcaaagatgttacttgtatcttcccaggacaaaagaaaattggtatagtagacaggacagggaatggaaaatctacgctggtgcaagccctctttcaagtggtggacccttatgaacgatgtatacttattgatggtgttgatatttccaagattggtctgcaagttttgagatgtaagcttggtataaccttgtttctaggtactgtaaggactaacttggatcctctggaacaccatgcagatcaagaactttgggaggttagcattagtagtcacaacactttcttaaaaataccaatgtttatcttattactgagagaactactcttttcaggttctcagcaaatcaaattgaagaagaaattgattcggacagacaaccattccatgattggcgcctttcgaatccctaccattctggctaattccatggttattgtgatattttatcttttatgttttgtttcaattagttaa

SEQ ID NO: 3952 - DNA, 465 bp, Glycine Max
ttgaatttgatttctcttgctattgaacgtgctattggactgaactacgctgttgaattgaatttgattgtgcggattgctataaaaaaacatatcctgagaatacatttgattaccatgaaatacattatattaaatcctggaggaaaaattctaattacagattactgcaaaagtgctggaagtccatctttagaatttgatgagtacattaaaaaaggaggatattatccccatgacattaaagcgtataggcagatgctcgaggatgctggatttgatgatgtcattgctgaggatcgaactgatcgggagttagatgcccttgagaacaagaagggcgattttattcgtgacttcagcgaagaagactacaatgagattgtggaaagatggaaggcaaagcagaccaggggtgcatctagagagcagatgtggggtttgttcattgccaagaaaaattga

SEQ ID NO: 3953 - DNA, 255 bp, Glycine Max
ttgattgattctctttcacatattcacatcacttcggctttatctttatccatggcacctacagcagcaatgctcttgctctcccacaatggcaaaacacccataccttcatcatcatcatcatcatctgcaacaacttattattttaggttgaaagactctgcactcaaatgggtttccaaatacaatcccgtgcccaaatcaggatcaaagaataagaggttcgaagaagcacttcaactttgcagctgctag

SEQ ID NO: 3954 - DNA, 226 bp, Glycine Max; identical to SEQ ID NO: 607

SEQ ID NO: 3955 - DNA, 374 bp, Glycine Max; identical to SEQ ID NO: 608

SEQ ID NO: 3956 - DNA, 1500 bp, Glycine Max; identical to SEQ ID NO: 609

SEQ ID NO: 3957 - DNA, 945 bp, Glycine Max
ttggatatcgacatcagacggcggaagacgagaatgtctccaaagctcccttcacatctcttcccttggctcatcctactaacattcgcatctctctatttcttctcttcattcctctctctcagcacgttctcttcttcttcttcatccctctcaatctccaacacctgcaacctcttcagaggccagtgggtctccgatcccaaccacacccctctctacgaccaaacatgccccttccaccgcaacgcatggaactgcctccggaacgagcgccagaacatgaccctcatcaactcgtggaggtgggtcccacaaagctgccacttgccccggatcgacccggttcggtttctgggtacgatgaagaatagaaatattgggtttgttggggattccctcaatgagaatttcttggcttcatttctctgcattcttagtgtcgctgataagggtgcgaagaagtggaaaaagaagggtgcttggaggggtgcctatttccccaaattcaatgtcaccgtcgcttatcaccgtgccgttttgctctctagataccagtggcagccaaaacaacctgaagctggggtgaaagatggatcagaaggcttttatcgagttgatgttgatgttcctgcagatgattgggctaaaattgctggtttctatgatgttttggtgtttaatactggccactggtggaatagggataaattcccgaaagagaaacctcttgtcttttataaagcaggacaaccaatagttccgccacttgggatgttggatggacttaaagttgttcttactaacatggtcacatacattcaaaaagaatttcctggaaacacacttaaattctggcgattacaatccccgaggcacttttatggtggtgactggaatcaaaatgggagctgcttgttcaacaagccccttgaggaggatgag

SEQ ID NO: 3958 - DNA, 2249 bp, Glycine Max; identical to SEQ ID NO: 610

SEQ ID NO: 3959 - DNA, 1284 bp, Glycine Max
ttgtacatgattgatgccgtgcagcgcctaaatattgattaccacttccaagaggaaattgaagcattcctacggaggcaatatgtgaattctagtactattccgggtggttattatggtaatgatattcatgagattgcactttgcttcaggctattgagacaacaaggtttctttgtgcctgaagaggtgtttggcaagttcacaaacaaggagggaaagttcaaccaaaaacttggtgaaaatatcaagggaatggtagacctatatgaagcctcacagttaggcataataggggaagacatacttgctgaagctggagaatttagtggccaagtcctaaaggaaaaggtggattgtatcgataatctcgaagctatgtttgtgaagagaaccttagagcacccttttcacaaaagctttcccatgtttactgctagaaatttctttggtgatttccatggcacgaataatacatggttagattccttaaaagaagtggtcaaatggatttcaatttgcgggaatgcatgtaccatcgagagatcactcaaatttctaaggcttggtttagccaacgagttaatatatgcgagaaaccaaccacttaaatggtacatttggaaagggttgagctcacaaaaaccaatatctttaatctacataatagatgacattttcgatgtttatgggacactagatgaattaactattttcacagaagctgtttgcagatgggatattacagcaattgagcagctaccagattacatgaaggcatgcttcagagtcctctataatctcacaaatgaaatcagctccaaggtctaccagaagcacgggtggaaccccatagactctttactaaatgcgtggaagagtttgtgcaaagccttcccagttgaagcaaaatgtgctgaggaatacttaaagaatggaatagtaagctctggagtgcatattgtgatggttcatgctttctctcttttggggcatggattaaccgaggaaaatgttcaaatcatagacagaaaccctgtcatcatttcttccccggcaacaattcttcgactttgggatgacttgggaaatgcagaggatgttaatggtgatggtaattatgggttgtatatgaagtgctacatgaaggagcacccacatgtttctattgaacagacacgggagcatgtcactcgaatgatttcggatgcatggaaacgactcaaccaagaatgtctcatgagtcatgacagatgcaaatcctttaccatcatctttcactaa

SEQ ID NO: 3960 - DNA, 918 bp, Glycine Max; identical to SEQ ID NO: 611

SEQ ID NO: 3961 - DNA, 235 bp, Glycine Max
ttgtggtgcgaggcaaggagcaacgctggctacggggcactgaagtcagggttggcctttgcatgctcacatggagctgactgcagggcaattcaacccggtggcagttgcttcaaccctaacaccattcaaaaccatgcttcttatgcctttgacagctactatcagacccatgccaaaaaccctgctgcatgcaattttggtggcacagccaccattgccgttactaatccca

SEQ ID NO: 3962 - DNA, 573 bp, Glycine Max
ttgtgttgtggttacgaaaattgtgaaaaaaatattggacaaatgtacgaaattgtattccaaatacagatgtggccaggggaaagcttatcagctacaaaattggcacacaagttctatccaattattaaagccacagatgctaaattggcgagtgcaagagctgaagacgcggtgctgtgccagaatgggaccctggatcccaacaaggcgaagggaaagatctggacaagggagagcaaagcttttctagctggtgctgtgggaatggtccttgctaatgacaagactactgggaatgaaattatagcggatcctcatgtccttcctgcttctcatatcaattttactgatggtagtgctgtctttaattacatcaactcaaccaagttcccagtggcatatattacacatccaaagactcaattggatactaagccagccccatttatggcagcattttcatcaaaaggaccaaatactatggtgccagagatcctaaagcctgatatcactgcaccaggcgtgtcagttatagcagcctatactgaggctcaaggaccaaccaatcaa

SEQ ID NO: 3963 - DNA, 1149 bp, Glycine Max; identical to SEQ ID NO: 612

SEQ ID NO: 3964 - DNA, 1827 bp, Glycine Max; identical to SEQ ID NO: 613

SEQ ID NO: 3965 - DNA, 561 bp, Glycine Max
tttcaacagcattcatttactaagttatacaagggagccatgatagaaaagcataatttcctttcaacaatgactactaacaacactactgaggaagggagtgaacaagaacaaatgatatctgtaacttttattgacaaggatggtgaggagaagcatatcaaagtccctgttggaatgtctatgttagaagcagctcatgaaaacgacattgaactagaaggcaagagctttgattttagaattctattacttcgcctcaagattttgttttttgctgttacttttgctagaatcacttttcattgtggtagagcatgtgaaggctcgattgcgtgttcaacttgccatgttatagtcacggacttggaacaatacaataaattggaagatccaactgatgaggaaaatgacatgttggatctagcttttgggcttactgaaacatcacgtctgggttgccaagtgattgcaaaacctgaacttgatggaattcgtttagctattcctgctgccactcggaacttcgctgttgatggttatgtgccgaaaccacattga

SEQ ID NO: 3966 - DNA, 876 bp, Glycine Max; identical to SEQ ID NO: 614

SEQ ID NO: 3967 - DNA, 1385 bp, Glycine Max
tttctgagctggtttataatcgattataatcaatttgtccacctttataatcaatttctgcgctggattataatcgattacaattcacacttctatttgaaccaaattctcgatgctccaaatgttgtgagaaagaactacagaaagcaatatcttccagggccaatgtttgggccttattcctttataaatgtagttggtggcattgaagagtttgatgatgctggacgaagccggaaaaatatggttgaagtagcagttgtgatgaaaataattaaaaactgttttaaagcatggcgtgacttaaaggataacctcagtataggatccgtccctgctacatatgctgttggacagcggtatgatacacacgatggatttgatgtgaaggtgaaaacaattgatggtttccagggtggagagcgggacattaatatattatcaactgtacgaactaaacgcagtacttcgcttcaattcatctccaatcaccataggactaaggttgctcttacaagagctaggcatagcttactatctactataattttttttcattttttattttgtcccaaaataaatttttgtattagtcttgacatatggagtaatgctgaaattatgatattgaacaggactctaacaaatgaggaaaatgtttggaaatctttggtgcttgatgctaaaaagcgtcaatgtttctttagtgctgatgaagacaaggaattggcgaaaagtatctgggataccaagaaagagttggataagttagatgatttgcttaatgcagataacttctttttcaaaaattccaggtggaaggttcttttcagtgatagcttccttaaatcatttaagaaactgcgatcaaagcagactaaaaagttagttcttgacctcttgctcaaactctcaactgggtggaaacctaaaaggatgaaagtggacttattctgtggaaattcatcacagatattaaagcaattcaaagaaaagaatataatgcctccagaggatgtcccaaaattagtgaagcgtcttgataatatatttggaagctacactgacgaatttataagtcgctgcagtgagaaatgcttagagggttgggaaagatcagtagagatcactaaatttaagactcttgataataatggaaatgaagctgaattaggtggttgtgatcaaagaatttatgtggagaactcaaaggtcgaggagagtttgttattgatgaaattctactccttatcatcagttgtagttagtcacttgctttctgatcgtatcagtgatgaattcgacctgctgcaattccttctatttgttacagtcagtcctaaactatgtcaggcagtaaaacatcacgttgtgcgattgaaaag

SEQ ID NO: 3968 - DNA, 1299 bp, Glycine Max; identical to SEQ ID NO: 615

SEQ ID NO: 3969 - DNA, 225 bp, Glycine Max
tttgcctggtctaatgcgacttcttcattcgcaactaacatgtatcatagtagagggaaatttattataatttgtggcaataagtccaagcattggaaaaaagaaattaacacaccaaaacactacaaatataggaggaagggtgaccctgagtttgtgctagattttgaagagatttatgttatcgattccaaaaccaagtcaattaccagagccaaagttttg

SEQ ID NO: 3970 - DNA, 1419 bp, Glycine Max
tttgtgcaaagaagaagagtaaaaaatcttccaccatgtccaccaagtcttcccctaatcggcaacctccactacataaaaagcccactccaccgctccctcctcagcctatcagaaaagtacggccccatcttctccctctggttcggttcacgctttgtggttgtcatctcctccccaaccttgcttcaagaatgcttcaccaaacacgacatcgtcctcgccaaccgcccgcgcttcctcaccggaaaatacctcttctacaactactcaagcatgggctcctccccctacggcgaccactggcgcaacctccgccgcatcatcaccatcgacgtcctctcgacgtcgcgcctcaactccttctttgaaatccgaagggaggaaaccatgagggtcatacaaaagcttgctagggaaacatgcaatggcttcgccctggtgcatctcagacccaggctcacagagatgacattcaacaacatgatgagaatgatatcagggaagaggtactacggcgacgacatcgaggcggcggatgcggaggaagcgaagcaattcagagacataatgacggaggttatgtcgctgttgggtgcaaacaacaagggagacttcttgcccttccttcggtggtttgattttgacggtttggagaagaggctgaaggtgattagcacgagggcagattcgttcttgcaaggactcctcgaagagcatcgtagtgggaagcacaaggccaacaccatgatagaacatctcttgactatgcaagagtctcagcctcattactactcggatcacattatcaaaggccttattcagggtatgctgcttgctggaacagacacaacagccgtggctatagagtgggcagtatcttctttattaaaccacccagagatattgaagaaagcaaaggatgaaatagacaacatggtaggacaagatcgcttggtggatgagtcagacattccaaaacttccttatcttcaaaacattatttacgagacacttagattgtttgctccagcaccattactattgcctcattattcttcagaagagtgcaccatagggggattcactattccacgtgacaccatagtgttgatcaatgcatgggccattcaaagagatcctgaacattggagtgatgctacatgttttaagcccgagagatttgaacaagaaggggaagcaaacaagttgattccattcggattgggaagaagagcttgtcccggaatcggtttggcacatcgttcaatgggcttaactttgggattattgattcaatgctttgaatggaaacgaccaactgatgaagagattgatatgagggagaataaagggctggcattgccaaagctaattccattggaagctatgtttaaaacacgaccaatcagcgagaaa

SEQ ID NO: 3971 - DNA, 1167 bp, Glycine Max; identical to SEQ ID NO: 616

SEQ ID NO: 3972 - DNA, 1047 bp, Glycine Max
tttttcaaaatcttattttcggttcacagtgtagggtacatgtctcttgaagctgcgaaatggatcattaacccaactcaacgattcaaaggagaaaaacaaaagaatcattcaaatgaaatgcattctctgctctctttgctcacctcttctacactcaccacaatctcccttccctcatattacccttctcttcggttccccttctcgctctcagggttgaagatttgtgctttgaaggcctggagacgtgttatctacttgactttattcctccgaaggaattccttttcgacctttctcgtaaatcaaaatgcaagtaggattgttgggtttgatcatcggaaatcggtacttggacatattccccctgccaatgattgccctgagaatattatgattaatgtaaatcttgagaagagtagctccagtgttgtttatgagtactttgccggcaaatgtgaggatgctaatatttctaatggtgaggctccatgtttggtggactcaaaagacaaaggccgagtggagttgatgcttaagtacattgaggatggagatcttcgccgatggagcttgcctggcattagggcctttaatattggactgagtgaatggcggtcaaggtttaactgcatttctaatccatacatattgctgaaattaagtgctgaagatttaattactaaaggaaattcatgtgtgtcatctcgccagaatgctgcaagcaaattgctggaaaaggctttcagggttcgactgggtagaggattttatggagagtgcctgggagttcgggcagatgggaactccaacttaagtgatgaaatcggcaagcttcttagtgtaaaaagtgctgctactggtcttaggccaataggggctgtgatattcatgcaacggaataatctcaaaatgtgcttgcgtagcactgatagttccactgatacctctgaagttgcaaaggcttatggaggaggtggttccccaagttctagctccttcataataaggttggatgaatataaccaatggatttcagcctaa

SEQ ID NO: 3973 - DNA, 1086 bp, Glycine Max
aaaaagagagaaactatccttaaggaaaagttattcaggcaaaatggtggctacttgttacaagagaagctctcttcttatggaaatggagaaatggcaaagctttttacagctgaggagctgcaaagagcaacagataactacaataggagcaggtttcttggtcaaggtggttatggcacagtgtacaaaggaatgttactagatggaaccattgttgcagttaaaaagtcaaaagagattgaaaggaaccagatacagacttttgtcaatgaagtagtcgtattatctcagatcaaccacaggaacattgtaaaactattaggttgttgtcttgagacagaaactccaatactagtctatgaattcattcccaatggaacactgtcccatcacatacataggagagacaatgaaccctccccttcatggattagtcgccttagaattgcatgtgaggttgctggagcagtggcatacatgcattttgcagcatctatttccattttccatagagacatcaaacccaccaacatacttttagacagtaactacagtgccaaagtgtctgattttggaacatcaagatcagttccactagataagactcatttaaccacagctgttggaggaacttttggatacatagaccctgaatattttcagtctagtcaattttcagataagagtgatgtgtatagttttggagttgtgcttgtagagctcataactgggagaaagccaatttcattcttatatgaagatgagggtcagaatttgattgcacaattcatttctttgatgaaggagaaccaagtttttgaaattttagatgccagtttgcttaaggaagcaaggaaagatgacattcttgccattgcaaatcttgcaatgagatgcttgaggctgaatgggaagaaaagaccaacaatgaaagaggtttcaacagaattggaagcattgagaaaggcacaaagttcattacagatgaaccatgatcatgagcacacaactagtgacatagttcaagaatgcacagaggaaagcatgtcactgcccttacatctagagtttacatccttttag

SEQ ID NO: 3974 - DNA, 1581 bp, Glycine Max
aaaatgatgagtaatggtgatccattggatttgtataagcttttcatggtggtgaaggagaagggtggttatgatgctgtttgtaagaacaagttgtgggatttggtgggggaagaatatgggttgggtgtgaaggttggttcctctgctgaacttgtttatagtaaacatttgagttctctagaggcatgcttaaagaatgctactgatgatgggagggagttgtgtgatactaatagggtgaagggtgtgagtccagagtctaatggggacaagaaagttcagagcaaaggacttgttgatttggatatgctggacaatgggacggatgagcatattatcagaaacttgtgcagtcttaatactgagaggaatatactggaagagtttgatggggggaaaatattaactgtggatgcatctgatgcagagagcaacatgcctagattgtcggatggaagcaatgatgaagtcttgatattggatccatctggtgttgacaaagagatatttggtcgtaagaggaagagagagtctaagtcagaaatgctaagttggattactagcattgctaaaaatccttgtgattccacagtcggttcgattcctgaaaagtctaagtggaagttttacagtagtcaggagatctggaagcaggttttgttgtttcgagaagctgtctttctgaagaaagattttgagacaaccagtgaacagcttaattggcagggacagaaaatgcatccttctatgtatgatgatcgtgttggggcaatgaccccaagttctcatgctgaagatcgtgctgagaaattgttacctgactccggtactgctcactcaagccttgatagatgtgccagagtgcacatccctttggggccaaaccatcaagctgaagtgccagaatggactgtcataacttatgaggttgattcaaagtggttggggacccaaatatggcctccaaaaactgtaaattccaaatgtcgtctttttgaaagggaccccattggagagggaagacaaaattcatgtggctgccaagtacaaggttctgttgagtgtgtccggttccacattgctaagagaagggctaaagttaagttggaattgggtgaggcgtttcaccaatggaatttacataaggtaggtgaagaagttgggggttcatggacagagcaagaagagaagaagttcaaagatgtggtgaaatcaaaccctgcttcacttgataaatgtttttgggatcatcttttcaaaacatttcctaagaagagcagagaagatttagtcagctactatttcaatgtctttcttttgcagcgcagagcatatcagaataggcatactcctgataacattgacagtgatgatgatgaatcagaattcacaccattgaggaaaaattttaaatcacccttgattttggggagtaaaaaaattttacatgcttccaattttgagacatcccttctgtctgttggcagttttgacaagggttacttaaagttaaaagaacagcatatggaatatatagagcaacattttgttatagagtttcatgaacaaatgcagtga

SEQ ID NO: 3975 - DNA, 210 bp, Glycine Max
aaaattctaaagcccggttcacacaattggaccacgtttgctggcacgtttgggtatgcagctccagagcttgcccagactatggaagtgactgagaaatgtgatgtattcagttttgaagtgctttctcttggaatcatcacggggaagcatccaggagatctcatttcttcattgttttcttcgtcttcatcagcaacagacttttaa

SEQ ID NO: 3976 - DNA, 1140 bp, Glycine Max
aaactattaaggtggaaaatgaacatcaagaaattgaaaaatgacaattgcaaggttcattctctttctcagcataaccagtgcaggactggtggaagtcatgcattacctgaaggcataatctccaacacttctgatttggaaatgcggcatttgtgggatcttcctatgactaagacaatagagaataaggaaaatgcatcaaccaatttgtttgcaatggcagttgggataaagcagaaagatcttgtgaacaaattggtcaaaaaggtaatttcaaggggtgctctgtataaattcaatttcgttgtaatgctcttccactacgatggtattgttgacgaatggaatgactttgaatggaataatcatgtcattcatgtggctgtagccaatcaaagtaaatggtggtttgcaaagcgtttcttacaccctgacatagttgcagaatatggttatattttcctatgggatgaggatcttggagttgaacacttccaccctgataggtatgtttctattataaaaagtgaaggactggaaatatcacaaccagcacttgatagtaacaaatcagaggtacatcatcagattactgcacgtgggaggaggtcgaatgtgcacagaaggatttacaaaactggtggtagtggcaaacgttgtgatgaaagtagcactgctcctccttgcacagggtgggttgaaatgatggctcctgttttctcaagagctgcttggcgttgcgtttggtatatgatccagaatgacttgatccatgcatggggtctagatatgcagctaggctactgtgctcaggcattccactacggtcatcctactcttggaggcttagatgtgaatgaggtttcatctcggacaaaggatcatagagttgatgtaagtctgtcttgtcacaattttttagcccaaaccattggcacatgcttacgtttactaatgttaaaatcacaatgcatttttctgctccaaaatcactcatccagtcaactatcaatccctcctaaagtctcggctacaattctctggtatcaaattattgaatcaaagtccgtgaatggtcattatttcatttattcacaattaagactaaaaacacataacatggcatacaatcaataa

SEQ ID NO: 3977 - DNA, 1341 bp, Glycine Max
aacatctaccagcataacacaccttactctgccaccaagaatgacacctacttcaagttggtcacagaaacttacctaggcctcaccacatgtcaggcactgatgggtcagaattactatgcctctgatggcattagagttggttctgagctcacagttccagtagtatgtgcttgtcccactgaaaatcagacagaaagagggatcacttccttgctggtttactcagtgaaaaatggtgacactattaagtccattggagaggtttatggtgttgatgaacaaagtatgctagaggccaatgggttgccagtgccaacaagcacagagaacagcataatcatctatgccctaactcctatcttagttcctctcagaggcaagagttgcaaagaggacccggatagtttctattcaaatatacagatgtttctggctagttactgcatccaactgaatttgaaaaatttgtccttgtttgtatatttgcagaagctctcattttatggaaatagagaaatggccaagcttttcacagctgaggagctgcaaagagcaacagataactacaacaggagtaggtttcttggtcagggtggtcagggcacagtgtacaaaggaatgttactagatggaaccatagttgcagtgaaaaggtcaaaaaagattgaaaggaaccaaatagagacttttgtcaatgaagtggtgattctatcccagatcaaccacaggaacattgtcaaattattaggttgttgtcttgagacagaagctccaataataatctatgaattcattcccaatagaacattttctcaccatatccatgggagacaaaatgagccctcccttctatgggacatggcatatatgcattttgcagcttctattcccattttccatagagacatcaaacccaccaacatacttttagacagtaactacagtgctaaagtgtctgattttggaacatcaagatcagttccactagataagactcatttaaccacagatgttggaggaacttttgggtacatagaccctgaatattttcagtctggtcaattttcagataaaagtgatgtgtatagttttggagttgtgcttgtagagctcataactggtagaaagcctatttcattcttatataaacatgagggtcagaatctgattgcagagtttatctcttccgtgaggcagaaccaagtttatgaaattttagatgccagggtacttaaggaaggaaggaaagatgacattcttgccgctgcaaatcttgcaatgagatgcttgagacttaatgggaagaaaagaccaacagtgaaagaggtttcagcataa

SEQ ID NO: 3978 - DNA, 895 bp, Glycine Max
aaggacaagtcgttacaaactacaatcaccatatttgtgcctactattctcgttgttgttgttctgctcatctttattagcatatattttaggaggaagaaagcaaggaaaatccttctatttggtaggtatgaagacaatgatgaaattaaaacggttgaatcattgcaattcaacttagacacaatacaagttgcaacaagtaacttcctgcttttaataaactcggaaagggagggtttggaatttatatatatcacctcttcatcaaaacctttttttgttagacctcttcatcaaaaacaagttaggctacttggttttagtttggcagggagagaaaagctacttgtttatgaatttgttcctaacaaaagccttgattacttcatatttgatccaacaaagaaagcacaattggattgggaaaagcgctacaaaatcattagacgtattgctcgaggccttctctatctttatgaggattcacgattacacatcatacatcatgatctcaaaccaaataatattctcttaaatgaagaaatgattcttaagataacatattttgaaaatacaaatagagttgtcggaacctatggatatatggcaccggagtatttaatgcatggacaattttcagtgaaatcagatgtcttcagttttggtatactagtccttgagattgtaagtgaccaaaaaaactatggtagtagtcttggggagaatggtgaagttttgttaagtttcgcatggagaaactggcaagaagggacaattacaaatattatagatccatcattaaacaattattcacaaaatgaaatgataagatgcatccaaattggtttactgtgttcaagaaaatttagccaacagaccaaccatgactact

SEQ ID NO: 3979 - DNA, 465 bp, Glycine Max
aaggcaaatgtagtacgtgaagctgtcaaatatgtgaaacaacttgaagaacgtgtgaacgagctagaaaatcaaaagagaaaggaaggtgtgaattcaataatactcaccaagaaaacgccactctccataaataatattgatcaagccatcactcatggatgtgtggatgtggaagaagaaatcctcgagctgaaagtaactgttttagataaggaattgctcattggaatttattctgagaaacaaaggcagacaatgctcaaaatattgtcattgcttgatgatctccatctttctataacccctctttctataacccctactagcgtattgccatttggaacttccactcttaaaattaccattatcgctcagatggatgacgaatataacatgataattcatgatctagtaaaagcactgcggcaacgcatattgaagtcacaggatatgcaaaagtga

SEQ ID NO: 3980 - DNA, 912 bp, Glycine Max
acatgctcaagttccacctctacttcatccattgtcggtggctcatctggttcatactccaagcatcttaccatgatatctataaagacttgccaacactctagtgcaatctttcctttgatattcagatcaattttgtcttcaacaggaggatcgaagttggaacctgaacctcatcaacactctactgaacaggcttgtcgagattgcttacctacccagatcagacttcagaataagggtgttgagtgcccaagttcgtgtttgagttgtgaagaatggttggaaaattgctggcacgtgatggtaggatgttcaaaggctcagcaatgttggttagaactggatatgaggcatcttattgaactgctgttccatgaggtggaaggctttgctgagttggttttcagacttttcgaaactctaagggaggataagctaaaggagtgttgcatggtgttctggagtctctggcatgctaggaatgagagcaaaagaaacattcacccagtagttttgcattggatggctccgtctgaaggtaaagtgaagtgtaatattggtgcagccttctttaaagaaagtaactctatgggtattggagtttgcttgaggggtcaccatggtaagttcttacatgcaaaaactcatgactttgaacttctgtccttagctattaggtggctgagaagtatgaatatggatattgttatatttgaagttgatagccagagagtgtacaatggtatgaagcgtaggtctctagacccttctgaatttggcattattattatgcagtctaatctaatggtccataacttgactaaggcttatagagattacgctagctctcaacatttttatcatcctccagattgtattgtggctctaattgctaatgaaataatatga

SEQ ID NO: 3981 - DNA, 1755 bp, Glycine Max
accctccccacgatccccaccaccaccctccaaaacccaccacacaaaacctcccagattcgccacccccagaaaacacagaacaaaaaagccaaaacccttcaccgaaaaaacgcgtttccgtgctcctttcccctccacaacaaaaacccaatcttcatctacaaagacatcaaatcgccagaacaagctcaaggaagctcttaccatcttggactaagtggaccaacgcggcattcccgtcgacgccaccactttctcttcggtcatcgccgcgtgcattcgcaccaagtcactgccccaaggaaaggaagttcacacccacatcagaatcaatggactcgaaaacaacgctttcttacggacaaagcttatgcacagaaactgtttgatggattgccctgtgagagcgtgtacccgtggaatgctctgctcagagggactgtggtttcggggaaaagacggtacattgatgtgctcaagacttatactgagatgagggcattgggggttgagttgaatgtgtatagtttctctaatgtgattaagagctttgccggtgcaacagcatttttgcaaggattgaagactcatgggcttctgatcaagaatggattggtggataactacattcttagaaccagttttattgataagtacttcaagtgtgggaaagttatgcttgcgtgccgggtgtttgaggagattcccgagagggatattgttgtgtggggtgcgatgcttgctgggtttgcgcacaataggttgcagagggaggtgttggagtatgtgaggtggatggtggaggagggagtgaagctgagttcggttgtgatgactattgttattcctgtgatctgggaggtttgtctgaggaggttgggtcaggagtttcatgcttatgttgtgaaaacgaagtcatactctaagctggtgccagttcagtctgctttgattgatatgtattgcaagtgtggggatatgatttcggcaagacaggttttttatggttcgaaggagaggaatgtggtttgttggacggctctgatggcagggtatgctgtgaatgggaaactaaagcaggcactgaggtccacgatttggatgcagcaagaagggttcaggcctgatgtggtgacacttgccactgttcttccagtttgtgcacagttgagggctttggaacaagcgaagcagattcatgcttacgctttgaaacattggtttctgcctagtgtgtctgtaacttcttcattgatgacaatgtactctaagtgtggtgtttttgagtattctagaagattatttgataatatggaacaaaggaatgtgatttcatggaccgccatgattgattcttatattgaaaatggatatctgtgtgaagcacttggtgtgattaggtcaatgcaattgtcaaagcataggcctgactctgttggtataagaaggatctcggggaaggagattcatgggcagatattgaaaagggactttaaatcagtccattttgtttctgcagaacttattaatatgtatggttcatttggagatattaataaagctaatttggtgtttaatgcagttccagttaaagctggatttgttgatgatgcttgtagaatcttcaattcaatgcctagaaataagattgaagcatctaaggaacacttcgctattatggtgcgattacttacctgcaatggtcagctagagaaagctcagagatttgaacaaatgggttctttcttgtag

SEQ ID NO: 3982 - DNA, 2121 bp, Glycine Max
agacataaaagcaagaaggaagtgatggaggaaattatctcaaaaagcaagttttacaaggctcaaaaggcaaaggataaagaagaaaatgaaaacttggtggaagaattggataaggatttcacttccttggttcagtctgaagccttgttatctttgactgaacccaacaagatgaatgctttgaaggctctggaaaaacctgatgattatgacaaacttgtcaaacaaatggggttggaaatgcgtgctcgcccttcagataggacaaagacaccagaggagattgctcaggaggaaaaagaaggtctagagcaattggaggaagagcggcagaagaggatggttgcggctgaagattcaagtgatgaagacaatgaagattcagaaaagccatttgaacagaaaccaagatctatatctggtgatgatcttggtgattccttttctgttaatgaacaaattatgaccaagaagggttgggttgatgagattcttgaaagaagagatgaggaagattcttctagtgaagatgatgatggtgaagatcctgacaatttgggaagctctgaagatgctgatgaaggatcagatgaagatcttgatgaacacgagaaggatctttctttaaaagattgggaacaaagtgatgatgatgatattggtgcagatttagaagatgaagatgatagtgatgagaatatagaaacagctgcagaagaccttgatgaggtaaaaggatcggatgctgcagttcatataaaaaagcaaaaagaaatgcttctgttgaaatcaaaagagttggacattccttatataattcaagctccgaagacctttgaagaattatgttcactggtggataaacattcaaatgacaacgttattttgatcatcaatcggattcggaaaagtaatccaatcacactcgcagcagaaaatcgaaagaaaatgcaagtattctatggagtattgttgcaatattttgctgttttggcaaataaggaaccacttaatgttgagttactcaatatgctggtgaaaccgttgatagagatgagtaaggaaatcccatactttgctgcaatatgtgctcgtcgcagaatagaagctaccagaaaacaattcattgaaagtatcaaacaatcagaaagtagcagttggtcttcttcaaaaacgttgtgcctcttgcgtttgtggtccatgatatttccatgctctgactttaggcatccagttatgactcctgtgatattgttgatgtgtgaatatctgatgcgttgcccaatagtatctggtcgtgatattgccattggctctttcttatgctctatgcttctctcatctcgaaaattctgtcctgaagcaataatatttcttcgaacttcgctgttggcagctactgaaagtaaacatgtttcagatgaagattcccagttatatcatcttatggaactgaaagctatcaaacctctcctatgcattcaggagacagtgaatgagattagtcctctgaatttcttcaaaataatagacatgccagaagactcttctttcttcacttctgttagtttcagggctagtgtattagttgcagttgttgaaactttacaaggatatgtcaacgtctatgaaggtttaagttcatttcctgaaatgttcctaccaatttttaaattattaaatgagatagcagaacaaaaaaatatgccaaatgtattacgagataaaattaaagatgtggctgagctcattaagttgaaagtggatgagcatcacactttgaggcgaccacttcaaatgcggaaacaaaagcctgtaccaatcaaattactgaatcccaagtttgaggagaactatgtcaagggtagagactatgatcctgatcgtgaacaagctgaactgagaaaattgaagaaacagttgaagtgtgaagctaaaggggctgcacgagaattgcgtaaagacaactacttcttgctggaggtgaaggaaaaagagaggtctttacaggaaaaagatagagcagagaagtatggaagagctaaagctttccttcaagagcaagaacatgcctttaaatcaggacaattaggaaaagggagaaaaaggaggagataa

SEQ ID NO: 3983 - DNA, 573 bp, Glycine Max
agagattggaacaccccccacgaagcaccaattatggctctgaatctttgtatctcacctaagtttaaatgggttccttccttagatagtgcttcctattctttgagaccttcacttgggtcttgttttggtaacataaacattgctagtgtgagtctaagtactactagaagtttgagtttgaggaggagtgggagtgttagtgtaagatctagtttagaaactgcggggcccacagtcacagtgggacaggtcactgaggttaacaaggacaccttctggccgatcgttaaggctgccggggataaaaccgttgtccttgacatgtacacacaatggtgtggcccttgcaaagtgatggctccaaagtttcaagaattatctgaaaagtatctggatgttgtctttctaaagcttgattgcaaccaagacaacaggcccttggcaatagagctgggaattaaagtggttcccactttcaaaattctgaaggacaacaaggttgtaaaagaagttactggagctaaatacgatgatttggttgatgccatagacaaagttcgatctagctaa

SEQ ID NO: 3984 - DNA, 1080 bp, Glycine Max
agtgaagaaccaatgatcgtgcctggaacaatgtctgaattagcatttaataaatataagcgatggcaatggtggtgtcttgtgacactcagcatagcctttcttatagtgggccaatctgctgctgttatccttggaagattttattatgatcagggtggaaatagtaaatggatggctactcttgttcaaactgctgccttcccaatcttgttcattccattatttacaattccttcacctccagaggcttcaacttctgcttcatcttccatcaaaattattcttttgatatattttgttcttggaatcttaattgctgctgacaatatgatgtactccactggactcttatacctctcagcttctacctattccctgatttctgcatcacagttggctttcaatgcagttttctcatattttatcaattctcaaaagttcactgctttgattataaactctacagtggttctcactttatctgctgcactccttgcggttaatgaagactcagatgaaccatctggtctctccatgggaaagtacattattggtttcctatgtacccttggagcttctgcagtgtactctcttttgctttccctcatgcaactaacctttgagaaggttctgaagaaggaaacattttctgttgttttgcaaatgcaaatctacacgtcactcgtagccacttgtgcttccgtcataggcctatttgcaagtggggagtggcatactttgcatggagaaatgaaaggttttcagaaaggacatgttgcttatgtaatgactttggtttggacagcaatagcctggcaggtatgctctgttggtgttgttggcttgatattcctagtgtcttctctctactccaatgttataagcacggtctctttagccgtaactcctattgctgctgttatagtttttcatgataagatgaacggggtgaagataatttctatgcttttggctctttggggttttgcctcttatatctatcagaattatcttgatgattcaaaggcaagacatgcacaagctgttgctaagtctcacaatgattctccttgttga

SEQ ID NO: 3985 - DNA, 2055 bp, Glycine Max
atagaacaatataaagcagaaatcaagagacttcaagcatccgaggcagaaattaaagcactatctgttaattatgcagctctattaaaagaaaaagaggatcagattgttagattgaataaagaaaatggctcattaaaacagaatttcgaggctacaagtccagcatctgcaaatggtgcttacacagtcaagggaagtaatgaccaatcaccaaatccactgcataggttcacaactcaaatgaaaaatcgttatgctacaaacaatggaaccacatctactttggaatctgatgctagtcaaagtaagatggagcaagcagatatggtagagggaaaaagtagtcccacagccacagcagcagtacaacatactcatgagatacgaaaaatgaagttggaactagagcaagaacgcaaaaagttggcaaatattcagctaaaattccaggaagaagagaaattgaacaagtctttccaggaggagcttaaattgctaaagttggaaagagacaaaacaacaaatgaggtgagcaaattacacaatgaattgaatgagaaaatatcagaaataaaacgtctgcaattggagttgactagacgagaagatgaagaagcaggtgattctgtggatagcttcaaaagactaattgaaactttggagaaggaaaacactactcttaagttggaaaaagatgaacttgaggttgccctcaaatcaagtaggatggctagtaaaatgtcacctgatgattctcagattcagatcaaggttccaagcagtaacagtgatgtgagccaaaacttgaaagcaatatttactttacaggagcagttaccagatccttccaaaagttttccagggaacgaagacttggaaagatccttacataagctaagtaaagaattgaaggaaacgcaaaatgagaggaacaaagcagtacaagaattgacccgtcttaaacagcatttgttagaaaaggaatctgaagagtcagaaaaaatggatgaggatatcaaaatcattgaagaactacgtgatagcaataattatctaagggctcaaatagcacatcttgaaagaactctgaaacaggcaactgcaagtcaggagaaactgaagatggcaaacgacaatgaaattctgaagtccagggaaatcattgatgacctcaacaagaagcttacaaactgtatgagcacaatagatgctaagaatactgaacttgtaaatctacagacagctcttggacaatattatgctgaaattgaagctaaggaacatttagaaggagatttggctcgtgcaaaggaagaaacatctaagctttctcaactgttgaaagatgcagactgcagagcaaatgtattgatcagtgaaaaagaagaaattttagcaaagctttctcaatctgagaaggtacaatcggaatggagaagtagagtaagcaagcttgaagaagacaattccagattgaggcgagctcttgagcagagtatgacacggttaaatagaatgtcagtggattctgattttcttgttgacaggcgcattgtgataaaattactgatcacttatttccagagaaaccacagcaaagaggttttggatctaatggttcgcatgctgggattctctaccgaggacaaacaaagaataggtgttgctcaacaaggtccaggaaaaggtgttgtccgtggtgttcttgggtttcctggccgcctagttggaggtatcttgggaggaagtggttcaactgaatcagctgcaaatgtaggagtagataaccagtcctttgcagatctgtgggttgattttcttctcaaggaaacagaagaaagagagaagaaggagtcagaaggaagagataaatccatcgatgagtcacatgataaaagttttgatattaattcttctccaccacattccaatcagagttctcaccctcgtggatactttcagcattccgaacaaattggttcagagttctcaacagttccccttacatcatcagatagtaaaactactagttcaagacttcctagatactaa

SEQ ID NO: 3986 - DNA, 252 bp, Glycine Max
atcacagataaatctgactttttcttgtttggtatgattctaataaaagttgtgtgtggaaggaagtatttaatagaccctagagaaacagaatttctggagaaacctgttgaagacaaaattgatctgaatatcaaaggaaagattgcactagagtgttggcaagtctttatagatatcatggtaagatgcttggagtatgaaccagatgagccaccgacaatggatgaagtagaggtggaacttgagcat

SEQ ID NO: 3987 - DNA, 624 bp, Glycine Max
atgaaactcgactcgtatgggctcatgcaacagtccatttgctacgacagagcccggcaatggaccatatccgtatcgtggggctatgcggttcaaattttccggggcattttcctggcccgggacatggagataccggccagaacctttcttaattggtatcgccgggtagattataccagttttccgttcaacacgcgccctttcagccggaatacttgccataaacctttttttttttacttgtccaatgcaacctttgatggcgttggtgatgaaactgtgagtgagtatattcgggtccagctccacccggagtgtaattggaaaatgcccgatccgacccaaatccaagtaatgaaggtccttaagaaacccgacccgcacttgtgggacaaggttagatttgtcaagataaaatatgagtcatctaatcatcatctaacgattacaattaatagaatcccaccaaatcagtctcagaaaaacaacgatctcaaacccgttcaccgttggatcgtcgtgaaatttgagtatcatgttcgcaacacaatttcgagcattctcaccgttgggaatttcgatatcatgtctgaactgagagaaacacccttcgcattgtag

SEQ ID NO: 3988 - DNA, 318 bp, Glycine Max
atgaaatcgcgagatagatattacacttcatcgccccaaactcagaacacattatcgcagggaaaagagattcaattcaaaaactttaggaacacccatgaaattttgctccgagggaaaacgaaagggaccataatcattgaagggtttgtgcctaatctaaaactccaccatgaaattaaggaaaagaaaaaactagggttttggatttttatagatgacctatgtggatcgagggttatggagaaaatcgatcaccgaaacatgatggatcgcgaagaaggaagggggagtaagcgaaaagagaaggagatttga

SEQ ID NO: 3989 - DNA, 1116 bp, Glycine Max
atgaacaattgggacggtttattggacccattggacgagaaccttcgcgctgagattcttcgctatggccatttcgttgaggcagcgtataagtcctttgaattcgacccttcttccccaaactacgccacatgcaagttcccaaagaacacactctttgaaaagtctgggttacacaacacaggttacaaggtaacaaaacacctacgtgcaacctcggggatcaaactacctagctgggtagacaaagcaccaagttgggtcgcagcacaatcgagctacgttggatacgtagcagtgtgtaacgacaaagaagagatcaaacgacttggtcgaagagacatagttgtggcgtacagaggaacgacaacatgtttagaatggctcgaaaatcttcgagccactctgacacatgtttcagttccgtcgatcacaacggagaccacaacagaaccatgcagcatggaagaaaatggagcgatggtagaaagtgggttcttgagtttgtacacgtcaacagttagtaacaacaaatcatttatgagtttgcaagatatggttaggaaagagattggtcggattcgtaaaacttaccaaggagagaatttgagtttgaccataacggggcatagtttgggggcggcattggccactctcacggcgtatgacataaagaacagtttcctccagccgccgccgctggtgaccgtgatctccttcgggggtccacgcgttgggaaccgaagctttcggcggcggctggaggagcaagggaccaaggtgttgcgcatagtgaactccgatgatgttataaccaaggtgcccgggtttgtgttcgatgacgtggacaaaactgaggatgttgcggcatgcaatggcggtgtccaagtggcgaagtttcagaggtggattcgaaaacgagcggaagaagttcagtggctattgtactctgaggttggaaaggagttacgcctttgtagcagggattctccgtacctcaggggtgtcaacattgccacgtctcacgatttgaacacctacctgcaccttgttgacggctttgtcagttccacttgtccctttagagccactgctaagaggttccttcagcattga

SEQ ID NO: 3990 - DNA, 1359 bp, Glycine Max
atgaacggagaaggcctcgccgccggcgactcctcgccggagcacgtcactggagactggtactccgtgccggatctccggttgcgcgatcatcgcttcaaggtccctctcgatcactgtcggggactccattcttctcccaagatcaccgtttttgcacgtgaagtcgttgcagttgggaaagaagagcaaaacttgccatacttattatatttgcaaggtggacctgggtttgagtgccggcgtcctactgaatccagtggatggactaaaaaacgaggaacaggcttatcaactcccttgactgtgtcatcaatgtcacaattcaagtctgctgatgaattagctgactttttaaaatatttccgagctgataatatagtaaacgatgcagagtttattcgagttcgccttgttcctgatgctggtccttggacaatattgggtcagagctatggtggattttgtgcagtcacgtatttgagtttcgcaccaaaaggattgaagcaagtccttataactggaggaattcctccgattggaggtggatgtactgcagattcagtgtacaaagcaggctttgagcaagctatagttcaaaatgagaagtactacaagaggttccctcaagatattaaaattgttcaagaacttgttaattatttggctgaacaagaaggaggaggggtggctcttccatctggtggcttcctaaccccaagagggctgcagactcttggtctatctggcttaggatccagagctggtttcgagagcatgcactatttgtttgagagcgtgtgggatcctacttttgttccgggagcaccaaagagaataagttacaacttcctaagttcttttgagaagtggttaaattttgataccaatccactctatgctcttctacatgaatccatctattgtcagggttctgctaataaatggtctgctaatagtgtaagaactgcagttggagacaagtttgatgcaattagagctgccagagaaggactacctgtactttttacaggagagatgattttcccatggatgtttgatgagattcatgcattgaaaccattcaaagatgcagctcatatattggcagagaagaaggattggcccccattatatgacgttcaggttctgaataacaataaggtacctgttgctgcagctgtttactatgaagacttgtacgtgaattttaagctggccatggaaacagcttctcaaatagcagggattaggccatggataactaatgagttcatgcattctggcttgcgtgatgatgggagcaaagttattgatcatttgttggggatgctaaatggaaggaaacctctattttga

SEQ ID NO: 3991 - DNA, 1638 bp, Glycine Max
atgaactatgaagagaaattgttttattttgccaacttttattatcagccgcgagatacatccaaaggcttagacattctgcatgtcttgaataaccttcacaacttgtatgccttgtttctatctgagaatgatttcacaggccatttaccacctcaaatttgctctgctgggtcactactgcactttatagcttttggtaaccgtttcaggatctccaaaaataatatttcaggtggcataccaatcgagcttgttaaagcaacaaagctaggaaggcttcacctttcttccaaccacttgaatggaaagcttccaaacgaattaggcaacatgaaatcgttaattaagcttaagattagaaccaagtaccaaccatctttctggaaacattccaaaatcttgaagatttggatcttgttacggaacttgaatttgagcaatgataaaataaatggtagcattaccattgagtttcacaactttcaggctcttgaatctcttgatcttagtgggaatttgttgagtggaacaataccaagacagcttggaaaggtgcagcaactgcaatggttgaatctctcttgcaataatcttttggaagaattgcatccacttttgatgacattaacaaaagttgtgtggcagcgtaactggcttgatgcttttcccaaccaaccgcaatcaaacgaggcacaaggacattctactgccattatttattatcttgggtgctctagtattagtgttgtgtggggtgggcgtttcaatagaaagaacaatcagaaaaagcactatctgaagaagtgttttccgtatggagtcatgatggaaatgtttgagaatatcattgaagcaaccaataacttcgattacagatatctcattcgagtcagagggcaaggtactgtttacaaggctgagttgtcttcatgtcaggtttatgcagtgaagaaactttatttggaaacagatggagagaagcccaatattaaagcttttcaaaatgaaattcaagctttgaccgaaatctggcaccgtatcattataaagctttgtggattttgctcacgttcatggttctcatttttggtttacaagttcttggaagggtgtagcttggatcaaatactaatcaatgacgcaaaagcagctgcatttgactgggaaaagcgggtgaatattgttaaaggtgtggccaatgctttatcctatttgcatcatgattgctcacctccaattattcaccgtgatgtatcgagcaagaatgttcttttggattcacaatatgaaacccatgtctctgattttgggactgctaaaattctaaagcctggtacaaacaattggaccatgtttgcaggcacctttgggtatgcagctccagagcttgcgcagactatggaagtgactgagaaatgtgatgtattcagtttaggagtgctttgtttagaaatcatcatggggaagcatccaggacatctgatttcctcattgttatcttcaacttcagcaacagtaacttataatttgctactactcattgatgttttagaccaaagaccatctcaacctctaaaaatcaattgccggggatgtcattttggttgcaagcttggcactttcttgcttgagtga

SEQ ID NO: 3992 - DNA, 339 bp, Glycine Max
atgaactcagttgcaaggcgtttatcaagcttagtcagacattcaggtttcacacctgaacccttcaataatgggcatcatcaaatgcagcagctccagcaatgcagaggcataagagtgaaggtcatgggtgggaacttggaagcagcattgggattgatgcagcgtaagatgcaatcaagtgggattgagaggatgataaagcaagaacaaagattccatatcaaaaactctgagaagcgtgttttagcccaaaagaacttggagcggaagattcgatctgaagatcttgctaagaaacttaaggccattatgatcaagaaagtcaggggtctatga

SEQ ID NO: 3993 - DNA, 531 bp, Glycine Max
atgaagaaatttgtactcaggttagatttgccagatgacaaggcaaagcagaaggccctgaaaacagtttcaacactttcagggattgatgccatctctatggatatgaaggagaagaaactaacagtgataggaacagttgatccagtgaatgtggtgagcaaactccgcaagtactggcagacagacatagtctcagtaggtccagcaaaggagcctgagaagaaagaggagccaaagaaggaagagccaaagaaggaggaagagaagaaagaggagccaaagaaggagggtgaagccaaaaaggaagaggagaaaaaggaagagcctaagaaagaagaagagaagaaagaagagacaaagaaagaagaagagaagaaagaagaggagaagaagaaagaggcacctcccccacccccagacccagttttagagctggtcaaggcttatagggcttataacccccacatgaccacatactattatgttcaaagcatggaagagaatcccaatgcttgtgtcatttgttaa

SEQ ID NO: 3994 - DNA, 1344 bp, Glycine Max
atgaagatggtggtgagacatagggacttgagggaaatcgtggaggctattaaggagaatttcgataacgcggcttccgctggggatcaggtttctgagatgcttgagatcagtagggcgcagcttgatcggagcttcaagcaattgaggaaaactgtgtatcactcgagtagcatattgagcaacttaagctcgagttggacctcgaaaccgccgctggcggttaagtaccggctcgacaccggttcgctggatgaaccgggcggtccaaagagtctctgctccactttggaacgccttttggcgtgggagaagaagctctacgaggaggttaaggctagagaaggtgtgaagattgaacatgaaaagaaattatcagcgctgcagactcaggaatacaaaggagaggatgaagctaagatattcaaaaccaaggcttccataaataggctgcagtcactaatagctgttacatctcaggctgtgtctaccacctcaactgccactattggccttagggactctgatcttgtccctcagcttgttgatctcattcatggattcatgtacatgtggagatcaatgcaccactaccatgaaattcaaagcaatatagtgcagcaagtccgtggccttgtgaacagatcatcaagaggtgactccacttctgaactccacaggcaggcaactcgggaccttgaatcagctgtgtcagcttggcactccagtttttgtcgccttataaaatttcagcgtgatttcatcctgtccttgcatggctggttcaagctcagccttgttccagtccacaatgataacatcaacagtagggaaacctctgatacataccaatttttcgatgaatggaaacttgcacttgaccgtgtccctgacactgttgcatctgaagccatcaagagctttatcaatgttgtccacgtgatatcttccaagcaagtggaagagctgaagatcaaaaaacgaaccgagactgcatccaaggaacttgagaaaaaggcttcctctctgagaaacctagagaggaagttctacagctcatattctatggtaggcattagccttcctgattctgcacctgacaatggacaagttttggatgcacgcgacccacttgctgagaaaaaactggaactggcaacctgccaaaggcgtgttgaagatgaaatgctgaggcattcaaaagctgtggaggtaacaagagccatgaccctcaacaatttgcaaacgggcttgcctggagtgtttcaggcactgaccagtttctcttccttgttcactgaggctcttgaatcagtgtgtacccgttcatatgccatcaagtag

SEQ ID NO: 3995 - DNA, 1857 bp, Glycine Max
atgaagatgtttatgggtggccaaattttcggtgctggtgttattattgttagtttctttctgctgatcctctgtggcatggtttgtgggactgacagtgatatattctgcttgaaaagtgtaaagagaacacttgacgacccctacaattatttgcaatcctggaatttcaataacaatacagaagggtatatatgcaagtttactggggttgagtgttggcaccctgatgaaaacaaggtcttgaatctcaaactgtcaaacatgggactcaagggccccttccctcgcggcattcagaattgttcaagcatgacaggattagatttttcgcttaacagactctctaaaaccattccggccgatatatccacacttcttacatttgtgacaacccttgatctttcttcaaatgattttacaggggagatacctgcatccctttcaaattgtacctatcttaatacaattagacttgaccaaaaccaactcactggtcaaattcctgctaacttgagtcagctcccgcggcttaagttgtttagtgttgccaataatcttttgacagggcaagttccaatctttgcaaatggtgtagctagtgccaatagttatgcaaataattcaggtctgtgtggtaaacccttattggatgcttgccaggccaaggcttcgaagagtaacacagctgttatagctggagcagctgttggtggtgtgactgttgcagcattaggtttgggcattggaatgttcttctacgtgcgccgtatttcttataggaagaaggaagaggaccctgaaggaaacaagtgggcaagaagtctaaagggaactaaaacaataaaggtttctatgtttgagaagtcaatttcaaaaatgaacttgaatgatctcatgaaggctactgataacttcggcaaaagcaatattattgggactggaagatcaggaactgtttacaaagctgtccttcatgatggcacatcactcatggttaagagattacaggaatctcaacattcagagaaagaatttctgtctgagatgaatatactaggttctgtcaaacatcgtaacttggttccgcttttaggtttttgcgtggctaaaaaggagaggtttttggtctataaaaatatgccaaatggtaccctccatgatcaactacaccctgatgctggtgcatgcaccatggattggcctctaaggctcaaaattgcaattggagcagccaagggattagcatggcttcatcatagctgcaatccccgcattatccaccgaaacataagctctaagtgcatcttgttggatgctgattttgagcccaaaatttctgattttggccttgctagattgatgaacccaattgatacacatttgagtacttttgtgaatggggagtttggggatttaggttatgttgctcctgaatatacaaaaactttggtggctactcctaaaggggatatttatagcttcgggactgtgcttcttgagttggtgacaggtgaaagacctacccatgtgtctaaagctccagaaacttttaaaggaaatttggtagaatggattcaacagcaatctagcaatgcaaaactccatgaagccattgatgaatcactagttgggaagggtgtagaccaggagcttttccaatttctgaaggttgcatgtaactgtgttacagcaatgccaaaggagaggcctaccatgtttgaagtataccagcttctaagagccattgggattaattataatttcacaactgaggatgagatcatgttgcctatggacactggtgatgctgataacttagaagaacttattgtagctcgagagggacatgattga

SEQ ID NO: 3996 - DNA, 906 bp, Glycine Max
atgaagtgcaagaaacatacctcagaccttagcagcaccgttggcgtctgcgcctcctgtctaagggaacgcctcatagccctcgtcgccgcccgagtcatctcacgcgcctccgacgaatattccagaaactcagaccctaaccctccgccaccgttaatcttccctcgctccgtttcgccctacgtctctcgccggaagcccgactacgccgccgcctggcacgacgaccgccgcgacaggctcttctacagcactccgcagctcggtcccaccttctgcgccggcgattccgcctaccacgccgacgcgaagtcgttcaagaaacgcttcaacaagttccgcatattcgcgaagatcttcaggaccagatcggagaagttccagtcggatccgtcgtgcgagcaagcctcgtacgcatcgccgtcgtggttctcggcgttttttcccacgcgccggaggaacaaggatcggaccggaacgacggaggaatattcctcctccgccccgcggcggcggtaccgcccgtccgatcgcggaatgtcgccggtgacgaccgaggatttcggcgacgagtgcgatcagtcaccatcgggaagcggatacgtctcagaggcttcgccgtggtggcggagatcgccgacggtggcgccgtcggcgcggcggtcgaggttagggcacacgaagagctcgtctggttcgggtatggcgctttggctgagtcctctagttcgggcgagtccgaaccggaggtggaaccacaagggattgccgccggagatggcggcagcggcggaggtcagagccgcggcggcgaagcctcatctctccgccgcggcgtcgttttgcgccaaccgttccaggaagcttgcggattttggacgagtcaacaaccataaccgttga

SEQ ID NO: 3997 - DNA, 1083 bp, Glycine Max
atgaatgatggcaataaagaacagagttatgcaaacaactcgtcgatgcaaagaagagtaataagtaaaaccaaaaccatacttgaagaaactataatgaggctgttgtattgtgattcttctcctagctgcatgaaggtggcagatctaggttgctctgcgggaccaaatacacttcttgtgatatcaaatattattgacatggtttataaagcaagcacccacttgaatcatgaaccacccacactccaattttatctcaatgatttatttggaaacgatttcaattccatcttcaagtcactccctgatttctgtaaaagattgatagaagataagggtcataattttggtccatgctttattaacgctactcctggatccttctatgggaggctctttcccaataattccataaacctttttcattcctcctacggtctacactggctctctcaggatccattattggggtctagcgaggcatcgttacttaacaagggccattgttacatagttaacacaagccctccagaggtatacaaagcttaccttaagcagtttcaacaagattttaaattgtttctgaaatcacgttcgaaggaacttgtgcctggaggagcaatgctcttggtgttacttggcagaaatgaaattcctcctacagtaaacggttgggaaccaattagtctaatactcaatgacatgttcttggagggtttgattgaagaagcaaaattagactccttcaacataccagtgtatcaacctacagttgaagaaattaggcatgtgattcaggaagaagggtcattctatgttcaacgattagagattttcatccagcctttgggtgaaagcataaatgacggtggtgatgattcttttcttgatggaaatttaaaagctgaatcagtagccaagcacatgagagcaataatggagcctcttttgtccacaaagtttggtgcagaagttataaatgaactattcaccaggtttcaaaagaaaattatgcaactgatggaggtggagaaatcggagtgggctactttgatgatatccatgataaaaactgcttga

SEQ ID NO: 3998 - DNA, 1098 bp, Glycine Max
atgaatggtggcacgggaaaaaggagttatgccaacaactcttcgttccaaaaaaaattaatgcttaaagccaaaccaatgcttgaagaaactataacaagactgtatcgtgattcttctccaaactgcatgaaagtagcagatttaggttgctctgtaggaccaaacacacttcttgtgacatcaaatattattgatattgttgataccacatgcacccgcttgaatcgtgaaccacccatattccaattttttctcaatgatttatttggaaatgatttcaataccatcttcaagtcacttcctgatttctatacaagattgcaaggagataagggaaatgaatttggttcatgctttattaatgccacccctggatccttccatgggaggctctttcctagtaattccataaacttttttcattctgccaacagtctacactggctctctcaggatccgttatcagggttgactaaggagacaaaatcacttaacaagggcaactgtcacatagttagcacaagcccttcagaggtgtacaaagcttactttaagcagtttcaagaaggttttaaatcatttctaaaatcgcgttcggaggaacttgtgcctggaggagcaatggtcttagtgttaccttgcacttgcaaaaatgaaactctttcaaaaagcctttgggaagtaataagcctaacactgaatgacatgctctcggagggtttgattgaagaagcaaaattggactcttttaacataccaacgtatgagcctacaattgaggaaattaggcatttgattaaggaagaagagtcattgtttcttcaaagattagaggttttcaccgtgcctagggatgagggtgtaagtgaatgtggtgatgatttctttcttgatggaaatataagagctgaattcatagccacatacacaagagctgcaatggagcctctcttatctgcaaagtttgaggcacaagttataaatgaattgtttatcaggtttcgaaagaaacttgtgcaaataatgaaggtggagaaatttgagactgctaatttgatgatatccatgacaaaaattgctcgaagaagtgtttaa

SEQ ID NO: 3999 - DNA, 621 bp, Glycine Max
atgaatttcattcaattgcacaacatgtactcatcttactattatccttctagtttctgtggggcatatgcaacaaacttctctaatttgtggttcaatagaagaggtacctcaattgagccattctctgatcctccaaattccacttcaaatcttatggcaaactttggaactacacaaagaacacccaacactaccaccacaccttcaccaccctccttagacccttacgaaccaaaagggcctcatgaaaagttgtacactgatttcaaaatctactggcccttcaccatgcccctgacttcagaagctgcagcaattcgtgtcatcagaaacttggagcatcttggcttgtactacacactctttgtgtggatcatactcttcatagtcctcattcctcatcgtaagttgtcattgattatcttggtcatcatgacctatgtgatagttatttattgtttagttctaagggcataccccaaatctattttccttcatagaaccatagataaaaagtttgtgttggctttgctagtgtttgcaacatttgtgcagctgattttgactgaggcagggattcaacttgctgtgactttggcttgtgctgtgcctttttga

SEQ ID NO: 4000 - DNA, 315 bp, Glycine Max
atgaccgggaaggcgaagccgaagaagcacacggcgaaggaaatcgccgcgaaggtggacgccgccaccactaaccgcggcggcgggaaggccggcctgaaggaccgatccgggttggagaagggcgggcacgcgaaatacgagtgccctcactgcaaagtgacggcgccggacgtgaaatcaatgcaaattcaccacgacgcgcgtcaccccaagattccctttgaggaggacaaagtcgtcaatcttcacgcgacgcacgttcctgaatcctccaagcctcgccccggtgttcgcggaagcctcaagaagtga

SEQ ID NO: 4001 - DNA, 603 bp, Glycine Max
atgaccttccaacccgtccccactctccttctcttcctcctcctcgcgtctgcaaattcccattttgccctcgccggaaagcgcaaggtccacatccccgacgagttggacgacgtgttcgacgacgaggaggacgacgcgtggcgagaatggggcaagaaacccgaaccctctttccctccctccgatatctccaagctcgatccctcgcagatccagcaggagatgatgaagcgccacgccggacccgtgatcggattcgtcaagctccggtcagggactcgccggactccggacatggtagctgaatttgcaatgaaatggacacatgttctgagaactggagctgttggagtaaggtttatgggtgttgatctgaatacaatcatgttcaacttggaaagcatcaaagacttggaagagttgaaggaatttgtcttggaccaatcagaggcttatgagatcaaaatgggggatcaattttttcgaagacctggagatccacctcttgatgaagttattgagaagcacaatagtgagaaaggcaaagcagataatgctgattcagaggaaattgatccaaatgttaaaacagagttgtaa

SEQ ID NO: 4002 - DNA, 1395 bp, Glycine Max
atgactgctgctgtacaattgcttttctgttctctcccttctttcatacatacctgcatgttattcttagtactttatgtgcagggtatcttggctgagatcctagactttgtaatggggaaagggcttatcccagctgatggtgaaatatggcgagttagacgtcgtgctatagtcccagcattgcaccagaaggatgtagcagctatgattggcctttttggacaagctgcagatcggctctgccagaagctagatgctgctgcatctgatggagaagatgttgagatggaatcacttttctctcgattgaccttggacatcattggcaaggcagtattcaattatgattttgatagtttatcaaatgacactggtatagttgaggctgtttatactgtactgagagaagcagaagatcgaagtgttgctccaattccagtctgggagatcccaatatggaaagacgtatcaccacgtctaaggaaggttaatgcagctctcaaattaatcaatgatacgcttgatgatctgatagcaatatgcaagggaatggtggatgaagaagagttacagtttcatgaggagtacatgaatgagcaagatccaagtattctacacttcttgttggcgtcaggagatgatgtgtcaagtaagcaacttcgtgatgacttaatgaccatgctcattgctggacatgaaacatcagctgctgttttaacttggaccttttatcttctatccaaggagccaagagtcatgtccaagctccaagaagaggttgactctgtacttggagatcaatatccaactatagaagacatgaagaaactcaaatatacaacccgagtgatcaatgaggcattgaggctttacccacaaccacctgtgttaattcgccgctctcttgaggatgatgttcttggagagtaccctataaagaggaatgaagatatctttatatctgtctggaacctacatcgcagtccaaaactgtgggatgatgctgataaattcgaacctgaaagatgggcattagatggaccaagtcctaatgagacaaatcaaaacttcaagtatcttccgtttggtggcggaccacggaaatgtgtaggtgatttgtttgcttcctacgaggctgtggtagcactcgcaatgcttgttagacgattcaactttcaaatagcagttggagctccaccggttgagatgactactggagctacaattcatacaacacaagggttgaagatgactgtaactcacagaataaaacctcctattgtgccctcattacagatgtcaactttggaagtggatccatccataagcctttctgatcaagatgaagtaagtcagaaaggcgaagtttaccaggctcaggctcagtcctaa

SEQ ID NO: 4003 - DNA, 150 bp, Glycine Max
atgagaacaaaaactccgccatcgctcttgtctctcaccattgactctgccgtccttaatctccccgacatctccgatctctcccatatccctgatcacatcctcctcgacctctttttgaaagcattgctacatgaattgttgaggtga

SEQ ID NO: 4004 - DNA, 537 bp, Glycine Max
atgagacaaagaatggacaggcttgtcattcttcctttctctgctggttgcatctctgaggccagtgttgctgttggtgttccacatccaagaagatcaaaaccagacaccaatgcatcacctcctacaatagaacggtctaaaagcgtcgaggattcagagattttgtctggtgaaagcatgaagaactcgttgaggctgctagacgttgttccaaagtctaacctatcctacggcttcaatagactggtcaagggtttcaagaatttttctcaattgtttgtggaaaaagatgagtttgaagaagtggaaatagacatggaaatagggtgcccaacagatgtgcagcatgtgacacacattggttgggatggcattgcaacttctgctgctgaccccatgaagggatgggatgcccttattcctcctgagctcctctctctatcatcctctcaatctttaaagcacctggacctccctaatttggaggcaaaacatgatgaagcatcgtctcccgttaagccttctcctaattaa

SEQ ID NO: 4005 - DNA, 1086 bp, Glycine Max
atgagcaattgggacggtttgctagacccattagacgacaacttacgtgctgaaatcctaagatacggtcatttcgtggaaaccgtttacaaatccttcgagtttgacccttcttcacccaactatgcaaactcgaggttccccagaaaagatcttttagaacggtgtggtttacataacactggctacaaggtaaccaaatacctacgtgcaacctcgggtattcagctacctagttgggtggacaaagcaccaacatgggtggcaaaacaaacgagctatgttggatacgtagcggtgtgtcatgacaaggaagagatcaaaaggcttggtcggcgcgatgttgtggtggcatatagaggaaccaccacatgcttggaatggttagagaattttcgtgcatctctcaccaacctccctattccatgcaacaccaaaagggcctttgaaaaaaatggggtcatggacagaagtggggccatggtggaaagcgggttcttgagtctctacacctcatcacttcccagaaagacgtttaggtctttacaagaaatggtgaggcgagagatttcaaggatcctcgagacctaccggggggaacaattgagtctgaccgtcaccggtcatagtcttggggcagcattagccacgctcacggcctatgatgtcaagaccgctttccctggactgccggtgacggtcatctcctttggtgggccccgcgttggggacccgaggttccggaggatgcttgagaggcaagggaccaaggtcttgcggatagtgaactccgacgatgtcatcaccaaggttccggggtttgtgtttgatgatggcttggccagcgatggaggggtccacgtgccgggatttccgagatggatacagaagagggtggaggaggcacagttagtgtatgcggaggttgggagggaactacgcttatgtagcaaggattctccgtacctaggaaacacgaatgttgccacgtgtcacgagctgaacacgtatctgcacctcgttgatggctttgtcagctccacgtgtcccttcagagcctccgcaaagaggttcctccagcgttga

SEQ ID NO: 4006 - DNA, 1053 bp, Glycine Max
atgagccgggcacaggatgcaaaccgatcattcttcccttttggaaatccttttaggatgatatcaccgaaaggcccaaaaatttcttcacagctgttgttaatattacatgcttttgaagcaactttggaagagaggctgaaaaagcttattcccaagagcaaggatgagatcctcagcttgtcttggatgactttggccatgcaggcactttgtgagagtcataatgacattaaaaccctcataacagagcttgagcttcctgtacatgattgggatgagaaatggatagatgtgtacttggacattagtgtgaagttactagatatatgcattgcatttagctctgaattatcacgcctgaaccagggtcatcttttacttcattgtgcattgcacaatttaggttcttcctcttcagagcagtatgttcgggcatgctcttcacttgatggttggaaacagcatattggttctggaaaccctaggattgagaaatgtggcagcattttggataatcttctgcggtcacttgatctgccaaaggttaaaaagtctgctaaagggaaggttttgatgcaagctatgtatggagtaaaggtgcagacagtatttttatgcagtgtgtttgctgcggctttttcgggctctacaaagaatatgtcagatttggatgtggctgatgtatattcttgggctccaacctttaaaagtttgcaagatcttgtaaatggggaaattagagttagaagtgggcgatttactatattgaatgagttggaagtagttgattcctctgtgaaggaattatatcctattatccagggcgtctcagatgccattgagacagaatcacttgcgaagattgttggggaattaggcagagcaacagagaagctttcacaaggactagatcttcttacaaaggaagtcgatagctttttccaagtggtcttgactggtcgtgatgccttgctatctagtttgaggtcaggtgcaactttcattgacagcattcaggcgggtaacagagatgcacaaatagtcaattga

SEQ ID NO: 4007 - DNA, 1236 bp, Glycine Max
atgagctcgaaggagagacccactcttggtggcacgcggattaagacccgcaaacgaaatattgctgcgccgctggaccctgcagcattctcggatgcagtggtccagatttatttggataatgctggtgatctggaacttattgctaagagtattgaatcttcagaccttaacttttcaagatacggtgacaccttttttgaggttgctttcactgggggtcgtacacaacctggaactaccaagcctgatgagggggaccgccacccatactctataatagagtgtgagcctaagcgtgaagtcattttaccatctgtaatctacatacaaaagattttgcggcgaaggccatttctcatcaagaaccttgaaaatgttatgcggaaattccttcagtccttggaacttttcgaggaaaatgagaggaaaaagttggcaatcttcacagcacttgctttctctcagaagctgtctggtctcccaccagaaactgtgttccaaccacttcttaaagataaccttgtggccaaagggctagttctgtcatttatgactgacttctttaaggagtatctgattgacaacagccttgatgatcttatttcaattctaaaacggggaaaagtagaggaggatcttttggacattttcccccctacaaaaagatccattgaagctttctctgagcatttcaccaaggaaggattggtggccttggtggagtataatgaaaagaaaatttttgaggtgaaacttaaggaaatgaagtcttctttaacagcacagataacagaggaggctgatacatctgaagtcattgagactgtgaagctgcgagttagagatgctaaattgccggaaattgaggtggtgcggatcttgtgggatgttttaatggatgctgttcagtggtctggaaaaaatcagcaacagaatgcaaatgcagcccttcgtcaggtaaaaacttgggcagaattgttgaatacattctgcaccagcgggaaacttgagctggagctgatgtacaaagtacagatgcaatgctatgaggatgctaaactgatgaagctgttccctgagattattagatctctttatgaccaggatgtgctggctgaagataccattcttcattggttccgaaaaggaacaaactccaagggcaggcaaacctttgtgaaggcgctggaaccctttgttaattggctggaggaggctgaagaggaggagtaa

SEQ ID NO: 4008 - DNA, 2346 bp, Glycine Max
atgagctttgaaagtgaagataagggcttgttggatcaggcaactgatcaaggattggaaaagaagttaaaaatttcatacacaagggagtttttgttatcgctaagtggattggacatatgcagagagttgcctagtggtgaatttgaagatgcttctcaagatcggcagagaagtacaggtggtttgtcaatgcatagttttagtcgacgcaatgagtatagttcatcccctcccaccaaaggcgatagcttttcccggggaatacatggaaaatgggaaactcgatcttcaggactgtctgataaagacagtgattctcaatctgaattggattcagattttggaaaacgttttggcaatcaatcgcgtagatcttggcaaggtcctgagcatgatgggcttctaggtagtggttcttttcctcgaccctctgggtatactcctgggttgtctgcctcgaaatttcgagctaatgacaactaccagctaaatcggtctaatgagccttatcatcctcctcgcccttataaggcacctcactcacgtcgggagactaatgactcttttaatgatgaaacatttggttctttggagtgtacaagtgaagacagggctgaagaagaaagaaaaagaagagcttcttttgaattgatgagaaaggaacaacataaagctttccaagaaaagcataagttgaacccggacaagaataacagcgattttgacacaacttcacttgctgacgacgatgagaaaatgctagttaataggagcaacaagtctgtggagcctcatgtgactctaccagctttaagcaatgatgagaaatcttcttccctttcacagactccttcagcagcaagaccacttgtaccccctggttttgcaagtacaaagttggaacgcaatttggcaaccaaaacatcccttaacactcattcaacagagcagcctgatcaaaaagcagatgagacatggagtccacatgccttccaatcttccaagtttgctcattggtttgttgaagaagaaaagaagccagtggatgacttgacacataggccaaatgacttgctctcacttatcgttggtggagaaaaaggaggattgcagaattctaatgtagaaacacccgagcctatagcagctaattttactttcctaaatcctgaatcaactgttttaccagcagttcttacatgtgaagatttagaacagtcaattttgtcacaagttggtgaaaatggttcatcacgtccacgacccattcaggacaaagattttgatgcaaaaactgagcagttgactccagagtcactaccggcaatgttcttgataatcccagagaagcaaatgttgatgagcttcaatcagttggagcacccctttctgttcaaaggggttcagttgcatctgcagggcctgatacaatgcacggaagtggtgtcctgccatcagaacaaacaaatcaacccaaatctaatagatttgaagagcagtggttggggtatgagtgaaatttccaaagctagtggtttcaaggggcctcatgatgttcaccttctagaagaagatagcttgattacagttaatttgtcccaagacacaacagttgacattactagaaaactggcagctctgaattctgcatttagagatgaccgactcattatgagaaatcaagaaggtctagctttccctcgtggtccatatgatatgagggaacctggtattccatatcagaatcttaatgtccaacgatctcctcagatccactctcagttgaatcacagtggtccaatgtttaaccaactggattctcatcctcctcatataagttcttatatgaagcttccaactcctgagagcatggttcatcatgactcaccaccaaatcatcaatttccaggaaatatgcttcgtcctcctttccatcaaacaaacaatggactagcagggtttgatcctcccgttcatcattctatgttacaacaacagatgcatatgcaaggaaaccttccctcacctcatttattacgtggattcccaagaggtgcacctatgccacctcatcccagcaatccaatgactggcttcatgcaggaaccaaaccctatgcaaggtcaaggcttcccatttaatggtcaccagcatcctacttttggtggccctggaatgcaattacaagctcctgatgttggcggtggaagaaatcatccagaagcacttcagaggctttttgagatggagctgaggtcaaaaaacccaaagccaatccatgcttcaggtcacagccaggggatgtatggtcaagagctagacttgggttttgggtatagatag

SEQ ID NO: 4009 - DNA, 1083 bp, Glycine Max
atgagtcaagacagtgagttcccaggttgtgagagcgtatacaccttccccgtctccgacaaaggcacccacatcgtgcgcctccacttccaccccttcaccaccccaaatctcgatctgggtctcgcccaatttcacgtcttgctcaacgctcacgtcgctctcagcaacttcactcgcttgctaagcgacgccacaaaccctagcatcgtcgagtatctcatctgggtcgacgcggagaagctcgaaatcgtgtttgttccgaacaaagactccagattggcgttcgtcaacgccattgaggtgatttccgcgcccaaagaccttgtccccgacaccgcacagtatttgagttcatcgaaattagagaaatttgagggtttgaacaaacaggctcttgaagttgtttacagggtcactgttgggggtgttaaagttaccccttttaatgattccttgtggagaacttgggttcctgatgatgggtttttcagaccaagtgttgggtcggaaaagctttactttggtgggagaatcaattaccatgttggaggggctagtcgtgaggttgggcctgataatgtgtataatagtgctaggttgattaggagtaagaatgattctgttcctaacgttaatatgacttgggtgtttccggttgttggagggtataagtacttggttcggttgcatttctgtgatattgctagcatttcggttggtttgctttacttcaatgtttatgtcaatggaaatttggcttatgaagatttggatctctcatacgttacgaattcgctggcttcgccgttctatgcggactttgtggttgatggaggagatggggccttgagtgttggtgtaggtccttcgaagagcagcatgccgcatgtcatcgatgggatattgaatgcggttgaggttatgaagttgaacaattctcgcagtagtcttgatggagaggtttgtgctgatttagttatgaagagctggtcgacgaggaataatacaggtatgctgtttactttggtggctgctgtttgcattgtgttgagcttgtccatagtgattcgtaggagttga

SEQ ID NO: 4010 - DNA, 1110 bp, Glycine Max
atgatagggtgggaagatgtatacaaagtagtggtagcagtggtgccactctattttgctctattattagggtatggttcactgaagtggtggaacatcttcaccaaggagcaatgtgaagcaataaacaagctagtttgttacttcacattgccactcttcatcttcgagttcactgctcacatcgaccctttcaagatgaacttctcgttcatagcagcagacaccatatcgaagttcatcatcatggtggtacttgccctctgggccaagtgcactcctaaatgcaccttttgctggtccataatcagcttctctttgtgcaatctcaccaacgctgttgttgttggggttccaatggtgaagcccatgtatggagccctaggtgtggaccttgtggttcagtcctcggttcttcaggccaccatatggctccctttgcttctctttgtgatggagttttggagaacgggaattgagggcaccaccaccaccaccgtaaaaccaagatcaaaaacaatgatcaataagaatgaaggtggaggagggaaagatgtggaggctgttgacgtgaaagaagagttgatgttggaagagagtgttactagtaggcttcctttttgcaaggtgatgaagcttgtgtggcgcaaacttgcaacaaaccctaactcctatggctgtgtgattggcatttcctgggctttcatatccaacaggtggaatttggagatgccaagtatgttagaagggtctatacagataatgtcaaaggccgggacgggcactgccatgtttagtatgggtattttcatggcacttcaggagaagttgattgcttgtggaccaagcatgaccttaatcggtttggttttaaagttcattgcgggccctgcggctacggctattggtgccattgctgtaggattgcgtggtgacgttttgcgagtcgtcatcattcaggctgctgtgccacagtccatcacatccttcatttttgctaaagaatacggattgcatccggaggttctcagcactggggtgatctttggtatgattgtttcacttcccgtcttagttgcctactacgcaatattggagtttgtacattga

SEQ ID NO: 4011 - DNA, 330 bp, Glycine Max
atgatgcctgctcatggcctcatcatctctctcatttttgtgtccattttagccaatgaggcaagcttggtccatgaggcaaatgggtcatttccaatggtgcccttggtggaggctgggaagatggagatgatgatggtgatgaatgagagcagaaggaaacttggaagcttccagatatgtgccttgtgcacctgctgtggtggagcaaaagggatgtgcttgccctctccttgttgctatgccatcaattgcaacattcctcatagaccttttggcttttgctcattcacaccaaagacctgtaattgctttggatgccatctttag

SEQ ID NO: 4012 - DNA, 432 bp, Glycine Max
atgattgtctgcgtcgccgtcgtcggtcaccagaacaatccgctgtacatacagagcttcacggaggccgatgatgctctcaagctccaccacatcgtccattgctcgctcgatgtggtcgacgagcgagtgaacaatcctaaaaagtctgggccgatgcttaatgagacgtttttgggactgctttatcctattgaaaactacaaagtgtatggatatctgactaatacgaaggtgaaatttatcttggtgaccacggatctggatgttaaagatgcggatgtaaggaatgttttcaggaggttccatgccgcatatgtagatgcagtttcaaacccattccatgtaccaggcaaaaagataacctccagaacttttgcagaaagagtgagcacaattgtcaagtcatttggcttgagttctgctgggtga

SEQ ID NO: 4013 - DNA, 2952 bp, Glycine Max
atgcaaaccttcttcttgtaccttttccttttcttcttgttatgtgcacttcaccaactagcctcatcccaacccttcttcctcaatagaaggattctccatgaaccctttgttcctttaaccactcttccaccttctgaagcaccaaaaccacaaccttctccttcaagccataaacaaaaaccaaaacccaaatatccatcatccaccattcccacaacctctaccactaccacaacaataccaacaccaactacaactacaccacaatcaccatttttcccattatacccttcttccccaccacctccttctccaatcacctttgcctccttccctgccaatatttcctctctcattcttcctcactcccccaaacccaattcttcctccaacaaactcctccccgtcgctctctccgccgtcgccgccgcggtccttgctataatcatctctgccgtcgtctgttaccgccgtcgccggagccctcccctcgctgccgacggcaaacttatccgatccgacaccgacctccgcctgctcccgcgcaataccgaaaccgccgtggaaactcgcaagctccggcacacgtcttccaccagctccgagtttctttacctcggaactgtagttaactcgcacataattgaagatggcgccgacgtctccgacgccggcggcgaccggaaaatggaatcgccggagctccgaccgcttccgccgcttgcgcgacaagcttctttgccgctgccgacgtacgacgaggcggggttcaccaccgcggaggaggaggaggacgatgaggagttttactctccgagaggctcatcgttgggaggctccggcggaaccggatcggcttcccggcgaattttcgccaccggaggaagaagcgtgatctctagttcgtgcccttcctcttcttccgcctcgccggaaaggcctcattctatcgcgacggcgagttcgagttcccggagaacccagccaaagtcgccggaaaattacaaccaccaacacgtgcaatcttctccttcttctccttcgttgtgctcaacaccagataggaaaaatgaagatgcattatcatcatcatcatcatcatcaccaccacgagcgccacggagactatctaatgcttcttcgtcttcggcattttctctaacatcttcgctggagaaggtaacacgtaatcacactttcgatcagtctccaagaatgtcgatgcctttgtcacccgccctattgtcatcaccggaaaccgaaagaggaacatttagtggattaagaacaggttcttttggtgcggctgcgacgcagaggaaacactggaatatttccgacatgtcactaacaccaccctttgatgaaattggaacggttccgaggaagcactgggagattccgggctctgctccgccaccgccgccaccattgccatggcaaaggaagcagtggggagtgccatcgccggcaatgaggccgtcgacaccggtgtcaaggccgccagaattggtgcctccttcgaggtcttttgtgttgcaaaaccaaggaaccaatgttgagttgccggcgagtttgggggaaattgaagagattagtaaaccaaaattgaagcccctgcattgggacaaagtgagaacgacctctgatcgtgaaatggtgtgggatcagatgaagtccagctcgtttaaattgaatgagaaaatgattgaaacattgtttgtagtgaacacatcaaacccaaaacccaaggacgcaactacgaactcagtttttcccctgccaaatcaggaggaaagaatacttgatcctaaaaagtctcagaatatttcaatcttgctgaaagcacttaatgtcactatagaagaagtgtgtgaagcacttttagaaggaagtactgatacacttggaacagaattacttgaaagcttattaagaatggcaccaagcaaggaagaagaacgtaagttgaaggaacataaagatgactcaccaaccaagcttggtctagctgaattttttttgaaggcagtgcttgatgtacctttcgcatttaaaagaattgaagcaatgctttacatagccaattttgagtctgaagtggagtatcttaggacatcctttcaaactctagaggctgcctgtgaagagctgcgacattgtagaatgttcttgaagcttttggaggctgtacttaaaactgggaaccgcatgaatgtggggaccaaccgcggggatgcagaggcattcaaacttgatactcttctcaagctggccgatgtcaaaggcgcagatggcaaaaccactctactgcattttgttgtacaggaaattattcgaaccgaaggtgctcgtctctccagaactaatcaaactccaagctctactttgagtgaagatgccaagtgtaggaggcttggccttcaatttgtatcaagcctgagttccgagctagcaaatgtgaagaaggctgctgctatggattctgaagttctcaacagtgatgtcttaaaactttcgaaaggaattgcaagcatagcagaagttgtgcaattaaaccaaaccatggcatcagatgaaagcagtcagaaattcacagaatcaatgaacaaattcatcagaatggctgaggaggaaattccaaaaattcaagcccaagaaagtgttacttccacccttgtgaaggagattacagagtattttcatggaaatttgacaaaggaagaagctcatccatttagaatcttcttggttgtaagagacttcctagcagttcttgaccgggtctgcaaagaagttggaatgataaatgagagaactatggttagttcagctcataaattccctgtgccagttaaccctatgcttccacaatcccttcctgggttacatgagaggcaacagtataataactcttcagatgatgatagttcttcttcatcaccatag

SEQ ID NO: 4014 - DNA, 1338 bp, Glycine Max
atgcaacaatacagcaccttcttgtgtctatccttcccttccaagttcccaactagtcctcatctctctgaaactacactccactccatctccatggaggaacacaaaaaagaagggttttttttgcccacaccagttgcaaaactaatatcctttcaaacggatttgatctataatggcctggtttctctcttttcccctatccactctcttttctccgtggcttctgagtcctaccaccgtgcagaggagaccaaagacagtgttgaatcagcagtgcaacgtgctctttctcatcaaatcactcatggcagcgcactcttgctgaagaaactaggactttgctttctgagtgttgcgtatgtgtgcatggttatgattttggctctcattctggctgctgtggtgggtgttgctttggttcggttgtgggtggaggaacccgtgtctgtcaaggataatctgcattttgattacactgaagctcaccctacggctgtgttttcattcaatggagttagaagtttaaagggtcaccttaagaaaaagcacataagtgtcccagttggccactcgtttttcgcttctttggtccttgtgatgcctgaatctgacttcaatagggagcttggcgtgtttcaggtgactgcagaactcctatctgtgaatggaaatgtgatagaaaaatctagccagccatgcatgttgaggtttagaagctcaccaattcgactagtccgaacctttatgatgggagtgcctctggtgctgggaatctcaggggagactcagaatattaatgtggatatactgaagcacaaagaagactacagaagaagcaattctattagggtaactctgcatccaagagcaggaacatcatctcttccacagctatacgaagccaaaattgcgataaactcccatttgccttggactaaagagttggttcgaaattggaagtggacattttatgtttgggtgtccttgtatgtctacattgtgctacttgtgtctctcctatgttgttataggccactcatctttctggtgacaccagagtatttcagtgatcatagggtgagtgaacttacaagagaagaacctggacaattacaagttgaggaattaggagatgaaagtgaggtttctgagttgttgaggaaatggagaagaagcagaagcaagagaaaaactgtactagcacatggtggtgtgccagaaaccattgttggttcatcaacatccagcattagcatgatgactactagagaagatgtaaccagtgtggctgtggaagatgaggttgaggactctgaatcagcgtgcataggttag

SEQ ID NO: 4015 - DNA, 1377 bp, Glycine Max
atgcaagaaccacataagagtgcggattctattataaagaaattatgggctaagattttaggaattggtccagcattcagaactataatgtcaatgagcagggatgactgggcaaagaagtttcgtcattggtgggatgaatttaaatctaccctgcaacactactggtttggtacaaaactactttgggctgatattaggataagctccagattattgttgaaacttgccggtggaaagagtctttctagaagggagaggcagcaactcacaaggacaacagctgatattttcaggctagttccatttgctgtatttatcatagttccattcatggagttattgttgccagtattccttaaattatttcccaacatgctgccttccactttccaggacaagatgaaagaacaggaggcattgaaaagaaggttaaatgcaagaatagaatatgccaagtttcttcaagatactgtaaaagaaatggcaaaggagattcagaactcacaaagtggagaaatgaagaagacagcagaagatcttgatgaatttatgaacaaggtcagaacaggtgctcgagtttctaatgatgaaatcttaggatttgccaaattatttaatgatgagctcaccctggataacattagcaggcctcgcttggtaaatatgtgtaaatatatgggcatcagcccatatggaactgatgcatatttgcgttacatgctccgcaaaagattacaggagatcaagaatgatgataaactgattcaagttgagggtgtcgaatctctttcagaagcagagcttcgtcaagcttgtagagatcgaggattgcttggattactttcagtggaagaaatgcggcagcagcttagggactggctggatttgtctctcaaccattctgtgccatcttccctcttaattctttctagagcattttctgtttcaggaaaggtcagaccagaggaagctgttcaagctacactctcttctctgccagacgaggttgtagatactgtgggggtgacaactttgccatctgaagattctgtttcagaaaggaagaggaagttggaatatcttgaaatgcaagaggagctgatcaaggaggaggaaaagaaagaggaggcagagcaggccaaaatggtagaatctgttggtagtgaaggggatttgggtattatgaaagagagggcttcaacaaccaaccaaacacaaggagaggtaaaagcaaagacattggataaacaggagcacctctgggagctcagccgtgcattagccgttttagcatcagcatctgcggtgagcagggaacgtgaagagtttttgaggcttgttagaaaggaggtatatagattctattgcatatga

SEQ ID NO: 4016 - DNA, 195 bp, Glycine Max
atgcaagatgagaaaacaaaaaagaacactccgtttttttcttctctctcttgctcttttggttttggatattgtgaaataatagataacatgcagatctgcgtaatcccccacaaagaccacaccacgaagtgcacaaccttttttattattattattaaacctttctgttgcaaaatcaacaaaaggggttag

SEQ ID NO: 4017 - DNA, 756 bp, Glycine Max
atgcagcatagaaaattgacttctggaaggccttctggaactgatggctctgattactcctaccgtatggtagttgattcaaggtatcaactggttgcaaaggggaagaaatacctgtctctgcactttatcactgaggctgtgttgctgttaataggagcaacacttgcatatttaccaggaatagaagcagatgctccaaatacagttgcctattcatctgttattgttagtgttgtttcactaataattgggaatataggtcgaagacgaagccggtccggtttgttgagattttatgctgttgtatcatctatagtgatgctactcttgattgcttctcttgccacgcagcatttgcttctgaagtcattagtcatcttgatcatttcatggggattcacaccagttgtgctcaaacagtacttcgaatgttggtgttttattaacttgtggggatttggttttagtttcccttctaacagaaatgtacttggtagctatgtttttaaatttggactattgagggtctacaccaagagttctcatgtgctttggtgtctagtttggatttatttgctatccaggattctaaactttggagaacagggaagtatgatgtcaatgatttatcgcattttcaaattggcaagtttgctgttatacatggtaaccttatccgtgcttaagctttgtaccgtcaaagcagttgctttccttctctttaacatggtgccccccaagaaaacctcttag

SEQ ID NO: 4018 - DNA, 279 bp, Glycine Max
atgcaggctaactcccttgctgagaaaaaaaatgagtttctcaacaaaatcaaaaacatagtattaaatgcagcagctgggatcctcacccaccctttacccctcaaaaaaatcacaccctccctaattccctctctctttctctctctctctctcccttcacaaatggctaacaattccttttctcattcccttctcttatttttttcttttttttattcactcccatgtcctctgatcacttcccccacctcggcctcggctactccatcgccatag

SEQ ID NO: 4019 - DNA, 6453 bp, Glycine Max
atgcagtcatttcaacagcaactgcttagaaaacctgaagggagtgaagcatttttggcatatcaagctggtcttcaaggagtatttgggagtaacaatttcccatctagttccatgcagttacctcagcaatctcgaaaatttgttgatttagctcagcatggctccaaccaggttcaaggtgttgagcagcaaatgctaaatcctgtacaagcagcatactttcagtatgctctgcaggcttcgcaacaaaagtctgctttggcaatgcagtcacagcagcaacctaaagtgggaatgctgggcccttcatctgtaaaggatcaggaaatgagaatgggaaatttgaaaatgcaggatcttatgtccatgcaggcagtgaatcaggtccaagcatcatcatctagaaattcatctgaacattttacttggggggaaaagcgggtagagcaagggcagcagctagcacctgatcagaagagtgaaggaaattcttcaagccagggaccagctgttggaaacttaatgcctggaaatattataagacctgtgcaagctctggcaactcagcagagcatcccgaacactatgaacaaccagattgcaatggctgctcagttgcgggctatgcaagcatgggcacatgaacgaaatattgatctgtcacatcctgcaaatgctaacttaatggctcagctcattccactgatgcaatcaaggatagttcaacaaccaaaggcaaacgatactaacttaggtgcaatgtcatcacctgtccctgtttcaaaccaacaggttacttctccggcagtcgcaagtgagagttcagcacatgctaattcatctagtgatgtgtctgcacaatctggttctgcaaaagccaggcagacggctccacccagccatttgagtccaccaattagtgctggtatagccagtagctctagtgacatggcagcacagcaattcagtcttcatggcagagacgctcaaggatctttgaagcaatcagttctaaccataaatggaatgccttctgtgcatccacagcagtcctctgcaaacatgaacttaggtgcagatcatcctctgaatgtaaaaacttcatcatctggttcagaaccagcgaaaatgcagtacatcagacaactaagccaatctacttctcaggctggaggtctgacaaatgaaggtggatcaggaaatcaccccaaaactcaggggggaccatctcagatgcctcaacaacgaaatggttttaccaaacaacagcttcatgttcttaaggcacaaatactagcatttaggcgtctgaagaaagcagaaggtgcactcccccaagaacttcttcgggccatcattccaccacctcttgatttgcaagtgcagcagccaattcattctgaaggagcacaaaatcaggagaaatctgctggaaatattgtggcagaacacccgaggcagaatgaggtcaatgccaaagattcacagcctatctcatccattaatggaaagaactcttcaaaacaggaagtctttgtcagagatgagaactccactgtaacggcagttcaggtgcaaggcacacctcgtgtgacaaaggaatctgctggaaaggaagagcagcagtctgttgcatgctctgctaagtcagatcaggaaagtgaacatggaattggcagaactcctgttagaaatgagttagtattagataagggaaaagctgttgctgctccccaggcttcagtaaatgacgcaatgcaactcaataaacctgcacaagcaagtgctgtttcccagacaaaggatgtgggatccaccagaaaatatcatggacccctatttgattttcctttcttcaccagaaaacatgattcgtttgggtcatcaatgatgatcaacaacaataatttgtcattggcatatgatgtgaaagagcttctttttgaggaaggcatagaggtccttggcaagagaaggacagagagtttaaagaagattgaaggtttattggcggtaaacttggagaggaaaagaattaggccagatcttgtgttgaggttgcaaattgaagagaaaaaacttcgccttttagatcttcaggcacgtttaagggatgagattgatcaacagcaacaagagataatggcaatgccagataggccataccgcaagtttgttaggttatgtgaacgtcagcgtatggaacttgctagacaagtgcaggcatctcagagagctttaagggagaagcaactgaaatctatatttcaatggcgcaagaagcttcttgaaacacactgggccattcgtgatgcccgtactgctcgcaacaggggggtggccaaatatcatgaaaggatgttgagagagttctcaaaacgtaaggatgatgaccgaaataaaaggatggaagccttaaaaaataatgatgttgacagatatagggagatgttgctggagcagcagactagcatccaaggtgatgctgcagagagatatgctgttctttcaactttcttaacccagactgaagagtatctccataaattaggaagtaagataactgctgctaagaatcaacaggaaggtctttctgaagaagaagtcagagcggcagcagcctgtgctggagaggaagtgatgattagaaatcgttttatggagatgaatgctcctaaagacaattcatctgtcagcaagtattacagccttgctcatgctgtgagtgagaaggttgtatgccaaccatcaatgttacgggcaggaacactaagagactatcaacttgttggtttgcaatggatgctttccttgtataacaacaaattaaatggaattttggcagatgagatgggtcttggcaaaactgtacaggttatggcattaattgcatacttgatggagtttaaaggaaactatggcccacatcttataatagtcccaaatgctgttatggttaactggaagagtgagttgtatacttggctaccgtctgtgtcatgcattttttatgctggagggaaggattaccgatcaaaattatattcacaagagattatggctatgaaatttaatgtcctggtgactacttatgagttcatcatgtatgaccgggcaaggctttcaaaaattgattggaagtatatcataattgatgaagcacagagaatgaaggatagagattcagttctagctcgtgatcttgatagatatcgttgtcaaaggcgcctgcttctgacaggaacacctttgcagaatgatttgaaggaactgtggtcgcttttaaatttacttcttccagaggtttttgacaataagaaagcctttaacgattggttttcaaagccatttcaaaaggaaggtcccactcaaaatacagaggatgattggcttgagactgagaaaaaagttatcattatccaccgtcttcatcagattcttgagcctttcatgctcaggcgtcgtgttgaagatgttgagggttcactaccaccaaaggtctctatagttttacgatgtaagatgtcagctgtccagagtgccatttatgactgggtcaaatcaactggtacccttcgtcttgatcctgagggtgagaacagtaagattcaaaagaatcctcattaccaggcaaaagagtacaagactttaaataacagatgtatggagctacgtaaaacttgcaatcatccatctctgaattacccattacttggtgaattatctacaaattcaattgtaaaatcttgtgggaaattgtggatcctggataggatccttataaagcttcaaagaactggtcatcgggttttgctgtttagtaccatgacaaaacttctagacctcttggaagactacctgaattggcgaagacttgtgtacagaagaattgatgggacaactaatttggatgaccgtgaatcggccataatggactttaatagccctgattccgactgtttcatcttcttgcttagtattcgagctgccgggagaggccttaaccttcagtctgctgacacagttgtcatttatgatcctgacccaaaccctaaaaatgaggagcaggctgtggccagagctcatcgtattggacagaaaagagaagtcagagttatctacatggaagctgttgttgacaaaatctctagccatcagaaggaagatgaattgagaagtggaggcactgttgatatggaggatgaacttgtgggtaaggatcgctatataggatccattgagagcctcataaggaacaatattcaacaatataagatagatatggccgatgaggttatcaatgctggacgtttcgatcaaaggacaacacatgaagagaggcgtttgaccttagagacattgttacatgatgaagaacggtatcaagaaaatgtccatgatgttccttctcttcaggaggtaaatcgcatgattgctaggagtgaagaggaagttgaattgtttgatcaaatggatgaagaactggattggcctgaggacgtgatgcaacatgatgaggttcctgagtggctccgagccaatacaagagaagtgaatgctgctattgctgctttatctaaaagaccatcaaagaacactttattgggtggtagtattggcatggaatccagtgaggtgggttctgaaaggagaaggggacggcccaagggaaaaaagcatcctaattataaagagttggaagatgaaaatggagagtattctgaagcaaattctgaagacagaaatgaagattctgcacaagaaggggaaaatggagagtttgaagatgatgggtatagtggggctgatggaaatcgattggaagaggatggtctaacttctgatgctggatatgaaattgccctttcttcagaaaatgctagaaataatcatgtggttgaagaagctggttcctcaggatcatcctccgacagtcaaagattgacaaagacagtttcaccatcagtttcttccaaaaaatttggctccctctctgcattggatgccaggccaggctccatttcgaaaattatgggagatgagttagaggaaggggaaattgtagtatctggtgattctcacatggatcatcaacagtcaggtagttggattcatgatcgtgatgaaggtgaagatgaacaagttttgcagaaaccaaagattaagcgtaagcgtagtcttcgtgttcgtccccgccatgccatggaaaggcccgaggacaagtctggcagtgagatgatttctcttcaacgtggagaatcatctgttttggcagattataaatatcaaattcaaaaaaggattgatccagaatcaaaatcttttggagactccaatgccagcaagcatgataagaatgaagcatcactaaaaaataagcaaaagttaccttcaaggaaaatagctaattcatccaaattgcatggatcacctaagtctaatcgtttgaattgcacatctgctccttcagaggatggcaatgaacaccccacagaaagttgggaggggaagcatctcaatccaaatggatcttcagctcatgggactaagacaaccgaaatcatccagagaggatgcaaaaatgtaattagcaagctccaaaggagaatagacaaggaaggccatcaaattgtacctttgctaacagatttgtggaagaggatggagaattctgggcatgcaggtggatctgggaacaatctgttggatttacggaagattgaccagcggattgatagaatggattatagcggagtaatggagcttgtgtttgatgtacagttcatgttgaggggtgcaatgcatttctatggatactcatatgaggtaagaactgaaggaaggaaggtccatgatctcttctttgatattttgaaaattgcgtttccggatacagactttggagaagcaagaggtgcactatctttctccagccaagctcctgccggtactgcagcatccccaaggcaagggacagttggccctagcaaaaggcacagaatgaccaatgatgcggaaactgatccatgcccttcacaaaagctgtcacaaagcggatcaacttctaatggcgaaaatgccaggttcaaaggtcatttgccacagaagaactcaagaaccggaagcagcagtgcacgtgaacaacctcagcaggataaccctccactgcttgctcatccaggtcaattggttgtgtgcaagaagaaaagaaatgacagggacaaatcattggggaagggtaggactggatcaactggtcctatttctccacctagtgctataagaagtccagggtcaggttcaaccccaaaggatgctagactggctcaacagggaaggggtagccagccatctcaacactcaaatgggtctggtgggtcagttggttgggcaaaccctgtaaagcgtttgagaacagattctggtaagaggagaccaagccatatgtag

SEQ ID NO: 4020 - DNA, 219 bp, Glycine Max
atgccaagaatgcactccacaccactcgagcacccactttcttcccttgaaggatccgtcacaacccttttgagaataaccaacaaaaatcaaaacctttcacaatccacacaacaccactttcttcttcaccttcagaattatgtcgttacttttgcaaactttcaaccaccacccccacacaacaatcacaattgcacacttttcagattgagatag

SEQ ID NO: 4021 - DNA, 714 bp, Glycine Max
atgccagctatgaataatatgctttccaagtggattccatggcatgcaccttggttctgtggttggcttggcattctaaccattgctaattctcaaaattttgggtggccatcagttttttactcttttggatcccttgaaagtaattggaggaaacaaagcaccttctccctgaaaacccatgcatatagctccccaaaagatgaccctaatcttggggtagaggagaaaaggatcatactggaaggcaatttatcaaatgcacatgtttcttccattccttggaaattgattttatcaaaggcacctgttttggctcttataatctcccacttctgtatctttgctaacattggtgggtggattgctgacacactagtgcgaaacggcatctccacaacagttattcgacagatcatgcaatcaatccggtttttggtacctgccatggctgtattgagcatgacgggtagtcagggatctgatgcattctcacaatctggtctgtattccatcaccaagtcattggaccacgctatgctggtgcatttgcttggactattgaataccgcaggggtgcttgctgctgtctttggtacagctgcaactggtttcataatccagcaaggttcttggaatgatgttttcaaggttgctgttgcattgtacatagtaggcacattggtgtggaatatattttcaactggggagaaa

SEQ ID NO: 4022 - DNA, 2109 bp, Glycine Max
atgcccacccagttcctcttttgcttcaaactcctctcccccttcctaaaaattgcacctttactctcatggtcatctctgccaaaccccaaccagagtttgcccagctgggtgggctccaactgcacttcatggagtggaatcacctgtgacaacagaactgggagggtgctttccatcaacctaaccagtatgaacctttcaggcaaaatccaccccagtttgtgctacctttcatatctgaacaagttggggttgtcccacaacaacttcacatcccctcttcctgaatgttttggcaacttgcttaacctaagagccattgatctcagccacaacaggcttcatgggggaataccagactctttcatgaggcttaggcacctcactgagcttgttttgagtgggaaccctgatttggggggtccactgcctgcttggattggtaacttctctgcaaatctggaaaggttacatcttggtttctgttcattcagtggtggcataccggagagcttgctttacctgaagtccctcaagtatttggaccttgagaacaacctcttgtctggtaacttggtcaattttcaacagcctttggttttgctcaatcttgcttccaatcagtttgctggtactttgccttgctttgcagcttcagttcagtctctaactgtgttgaatttatctaacaattctattgtggggggactacctgcttgtattgcttcttttcaagctttgactcatttgaacctgtcagggaaccacttgaagtatagaatatatcctaggcttgtgttctcggagaaacttcttgttttggacttgagtaataatgctttgtctggtcctattccttgtaaaattgctgagacaactgagaaacttggccttgttcttcttgacctttctcacaatcagttctctggtgaaattcctgtgaaaatcactgagttgaaaagcttgcaggccttgtttctctctcacaatcttctctctggagaaattcctgctagaattggaaatttgacttatctgcaggtcattgatctctcacacaactctttgtctggaaccattccattcagtattgttgggtgctttcagctgtatgctctaatacttactaacaacaatctttctggtgtaattcaaccggagtttgatgcgttggatatcttgaggattctggatataagcaacaacaggttttccggggctatcccactcactctggctggatgcaaatctctggagattgtagattttagttccaatgagctttctggatccttgaatgatgcaataaccaaatggacaaacctcaggtatttgtctcttgctcagaacaagttcagtggaaatctgcctagttggttgttcacatttaacgcaatagaaatgatggatttctcgcataacaagtttactggcttcatacctgatattaattttaagggtagcttaatatttaacaccaggaatgtcactgttaaagagccattggttgcagcaagaaaggttcaactgagagtttcggcggttgtttctgatagcaatcagctcagtttcacttatgatctttcctcaatggttggaattgatctatccagcaattcgcttcatggggaaattccaaggggcttatttggtctagctggcctagaatatctgaacttgtcatgcaactttctttacggacagcttccggggttgcagaaaatgcatagtttgaaagccttggatttgtcacataattccttgtctggacatatcccaggaaacatttctagccttcaagatctgtccattttgaatctttcctacaactgtttttctggatatgttccccagaagcaagggtatgggagatttcccggtgcatttgctggaaatccagatctgtgcatggaaacttccagtggagtatgtgatgatggaaggactcaatctgcgcaaggaagttctttcagtgaagataggatggatggcccaatttctgtggggattttctttatcagtgcctttgttagttttgattttggtgttgtggttctcttctgttctgcccgggcaagaaattacattctccaaacaaaagtttga

SEQ ID NO: 4023 - DNA, 1017 bp, Glycine Max
atgcccatgcccatgcacatgccccttcccatgccgctccagattcccttctccgcccaggacaccgccccctcctccgggaagcgccgccgtgacgacgaggctcctggcaccgccgccgcgccggatcaatcggcggcgaagcgcgccaagggacaggatgtgatattcaggatcgtcgtgccctcccgccacatcggcaaggtcatcgggaaggaaggtcatcgcatacagaagattcgagaagacacgaaagccaccatcaaaatcgctgacgctattgccagacatgaagagcgtgttatcattattagttctaaggacaatgatgaaaaagttactgatgcagagaaagctcttgagcaaatagcccatttaattttaaaggaagatgatagcagtcttgatgcgtcaaaagttactgcaggacatgtggctgccaatacgataagacttttgattgcagggtcccaggcaggtggattaattgggacgtctggtcaaaacattgagaagttgagggactcttctggtgcctctattactgttcttgcaccaaatcagttgcctttatgtgcttctgctcatgaatctgacagagttgtgcagttatcaggagatgttcctgcagtcatgaaagctttggaggagataggttgtcaactaagggaaaacccaccaagacaagtgatttcaattagcccaacatacaactatgctgcaattcgaccatcccagccatatcttgacccaacttcagttgattatgttacattcgagatgctgatttcggaaacgatggttggtgggttgattggccggtgtggctcaaacatctcgaggatcagaaatgagtctggagcaatgattaaggtttatggtggtaagggtgaacagaagcatagacaaattcaatttggtggtagtgctcaacaggtagctttggcaaaacagagagttgatgaatatatatactctcagttgatacaacagactggcacccaacagtcagcgtaa

SEQ ID NO: 4024 - DNA, 1854 bp, Glycine Max
atgcctcaccgtaacaaccctgcacctctccccctcgtcgtgaccctaaactgcgtcgaggactgctccctcgaattcgaatccctagctggcgtcgccaccgtccagcatgttcccctcagctgcctatccgatggcaagatcgagtccgccgccgccgtgctcctccactccctcgcctacctccctcgcgccgcccagcgccgcctccgcccctaccacctcatcctctgcctcggctccgccgaccgcgccgtcgactccgccctcgccgccgacctcggcctccgcctcgtccacgttgacacctcgcgcgccgaggagatcgcggactctgtcatggcgctcttcctcggcctcctccgccgcacgcacctcctctcccgccacccgctctccgcctccggctggctcggctccgtccagccgctctgccgcggcatgcgccgctgtcgcggcctcgttctcggcatcgtcggaatctccgcttccgctaggtctttggccactcgcagcttggccttcaaaatgagcgtgctctatttcgatgctcgcgcgggaaaaggaaaagtaaagttccctcctgcagcacgaagaatggatactcttaatgatttattagctgcaagtgaccttatatcactccattgtgctttaacaaatgaaacaatgcagattattaatgctgaatgtcttcaacatgtgaagcctggagcttttattgtaaatacgggcagtagtcaacttttggatgattgtgctgtaaagcagctcttgattgatggaaccttagctggatgtgctttggatggggcagaagggcctcaatggatggaagcatgggtgaaggagatgcctaacgtattgatacttccccaaagtgcagattacagtgaagaggtttggatggaaataagggagaaagctatatctatactacaaacattcttcattgatggaattataccaaagaatgccatttcagatgtggaagaagagagtgaggttgacaatgaaagtgaactatctgatcagcaatacaacgaaaatgctctccagattattgttagagagcaaacagatgatgttcatgtaagtcctgacaatttccaaaagaaagtaagtactcaaatgaaagagtcttcgtcccagcatcaggtttcaagtttgtctcagagtacctctgccagatctgaaggaaggcgcagcaggtcgggtaaaaaggccaaaaaaaggcatacccgtcagaagtcccaacaaaaacctgaagatccttctgcaccggagaaagaaggcacgtctcggagagatgatactgctatgagtggcactgaccaagctttgagctctagctctgaagattcacgaagtagaaaaactccaatagaatctatgcaagaacccactggtgctcaattcataaagtcaactgtgagacttagtggaaactgtactgaactattgaaagatggatatattatagctctgtttgcaagagaccgctctgcacttcatgtctctaggcaaagagttaaaggtggaggttggatcatggattccatgtcaaatgtgtcaaaaagagaccctgctgcgcagttcctcatcatcttcagaagcaaggacacaattggattgcgatcccttgctgctggtggaaaattgttgcaggtcaatagaagaatggagtttgtatttgctagtcatagttttgatgtttgggagaactggactctagaaggttccttacaggaatgcagactggtgaactgtagaaacccatcagctgttttggatgtacgcgttgagattttggccactgtaggcgaagatggcgttactcgttggcttgaatag

SEQ ID NO: 4025 - DNA, 2499 bp, Glycine Max
atgcctccgagaatagtgaagagaggtgctgcggcaaagagggcatcgaggggatcctcaaaggctgcacctgagaaccagcctgagcctgaaactacggaagtggttgtgaaaaataatcaagaaaatccggttgttgatgctgtggtggaagagaagctcgttgatgtggagcaagaacacgaggaagtaccaaatgagtcggctaaggtggaaaacactgaagaggaggttaaggagtctatagatgaatatgaaaaagatgaacacttagattttgaggataattaccctgagtacgaagcagaggagtatggtggtgttgactatgacgagaaggaaattgaacaagaagaaggtcaggaggagggagatgaagtagaggaagatcctgaagagattgtaggtgaagaagagggtgatacaggtgatgaagaagttgaatatgtttatgaagaagttgaggatgatgatgatgatgatgatgagcatgctgttgaagagtttgagcatgatgagcatgcacagaagcctgatgcggaggaagaggaacaccgtgaagttgtaaaggagaggcgaaagcggaaggaatttgaagtatttgttggtggcctagataaggatgctactgagcatgatctgaaaaaggtttttggtaaagttggggtagttactgaagtccggctgatgataaatccccagactaaaaggaacaagggatttgcattcttgcgctttgaaacggttgagcaagcaagaagagctgtggtggagctaaaaaatccagtgattaatggcaaacaatgtggtgttactccaagtcaggacagtgatactctctacttaggtaacatatgcaagacatggaaaaaggaagctttaaaggagaaactgaaacattatggagtagaaaatgtggaggatttgactttaatagaagatggcactaatgaggggatgaaccgaggatttgcatttttggagttttcatctcgttcagatgctaaggaagcctacaggcgactgcagaagagagatgttgcatttggagttgataagcctgcgaaggtttcctttgctgactcctttattgatctgggtgatgaaattatggcacaggttaaaactgtatttgttgattcgctgcctccttcatgggatgaagtttatgtccgagatcttctcaagaaatatggagagattgaaaaaattgagcttgctaaggacatgccagctgctcggaggaagaattatggatttgttacatttagtacacatgctgctgctgtggaatgtgctgatagcattactagtgcagggttaggtgaaggtgacaaaaaggcaaaagttagggctagattgtcacggcctctttcaaaacctcttcagagaggccgtggaaaacatgttaatcatggggactttcgttctggccgcaattctggaagattggtaagatcttcacggagtcgacctgcaccacgtagtcttcctgcccgtgtggtgagaggagttggaagtcgtgttccgcctgttagacctattagtgtgagaagtagacgtcctgtcacatccatgctagaaagatccaggccagtggctcctccagctagaagctatgacaggagattggctgctcctgcatatccaaaaagtggcatgaaaagagattatagacgacgtgtgaatctaccacctccgagaaatagagttgctgcagattatggctctaggttagcctctcagaggcacacatctcatagggattatcctgcccgtggctctaactaccctgagctgcatagaagtacatctcgtggttctgcaccaaagagaggttatgttgatgatggccatggccaaagatttgagagggctcctcctcctcctcctcctcccccccatctaagttaccgtgaaggacggccacgcgattatgacactctatctggctcaaaacgtccttatactgatatagatgatgttcctcctcggtatgataccagtgctcgccaatcaagatctcgtttaaattatgactatggaggtagtgcttcacagtatggagatgcttatggtgacagacttggaagatctagtcttggatatagtggcagcagaaattctatttctagtcaagacttacatggtacatatggcagtcgacaaggcatgagttatggcggaggttcttttggtggtagtgatggtggtatgtactcatcaagttatggtggcgattatgtatcccgtggaagtgatgttagtttctcatctttcttaattggaagtagtttgatttatggctatctgtctgtgacgttctcattttattgtgttcttgatgatgtagaggggtgggtgatagcagcaattatatgggtggtggtggatctgggtcatattattgagatcaagggttatgccaattcaagtcttctatcagatggacgaattttgagttcttcaatttgtgctgtaagtactgaagctgattag

SEQ ID NO: 4026 - DNA, 1524 bp, Glycine Max
atgcgatggataaaacgggcttccatacttaaggatgatggtacagttgaaattaaagtatcaggagaaggaagtaatattgagcatgatgttaaatgcgatgaatctcatgatgaattttgcgatgcaatacacagtcaggatattcagcctattgaaccacttcaaatcgtaatgcttatagttggcacacggggagatgtccaaccatttgttgccatggggaagcgtcttcaggaagatggccacagggttaggctagctactcataagaactttgaagattttgtcatgaatgcaggcttggagttttaccctttgggtggagatcccaaagttctcgctggttatatggtcaagaataaaggcttcttgccatcaggaccttcagaaatacatacacaaagaaatcaaatcaaggatattattaatactttgctcaaggcatgcaatagtcgttacccagagtctaatgccccatttaaagcagaagcaataattgccaatcctccagcatatgggcatactcatgttgcagaatatctaaaggttccacttcacatattcttcacaatgccatggacgcctactagtgaatttcctcatcctctttcccgtgttaagcaaccaattggctacagactctcatatcaaatagttgatgctttaatctggcttggaatacgagacttgataaatgagtttaggaagaaagagctgaagctaaagcctattacttatctaagtggatcttacactcacccttttgatgtgccccatggttatatatggagccctcacttagtccctaaaccaaaagactggggacctaagattgatgtggttggattttgtttccttgaccttgcttcaaattatgtaccaccaaaatcgctagtagattggcttgaagagggagaaaaacctatttatgttggatttggtagccttcctttacaacaaccagagaaaatgacgcaaattataattcacgctctggaagaaacagggcagagaggtgtcatcaacaaaggctggggtggtcttgggtctttggcagaacaaaataaatctgtgtatttattggacaactgtccgcatgattggctgtttccccgatgcactgcagtggtacatcacgggggtgctggaacaactgccgctggtcttagagctgaatgccctacaactattgtacctttctttggggaccagccattttggggagatcgggtacgtgctagaggagtaggtcctgcacccatcccggtggatgagttttcatttgataggctggttgatgccatacactttatgctgaaaccagaggtgaaaaagcgtgcagttgaacttgctaatgccatgaaaaatgaaaatggggtgctaggagcggttaaagccttctataaacattatccggccgagttcaagcgattagcctccacagccgaacccaaatcagttcataaatatttctctatacgaggatgctttggttgctctaaatcttctggatataaatag

SEQ ID NO: 4027 - DNA, 450 bp, Glycine Max
atgcgcacgaccaaggacgaccactttcaaaagctctgcagatcactcttcatagccctatgcaacctcgcaaaagcaaggtccaaattgaaaaacttttacaacgcccttcaagactgtgaccacactttggaactcgacgccacacatttgaagaacctttttgtttcagaatgggtatttggaaagatgcaaaagtttggagcttttgtcgaaaatggagtgtttggatatttcagattggtgggtttcaaatgggttcgagggaaggttccggagcttcaagatcacattggtgccgtggagattagaagatctgagatcaatgggagatggttgttttcaaccaaaaacatgtgttgggtcgttgttattggtcaccaaggcaattcccaggtaaaactaacaacaaaattcaacaaaccaatttttattgtttttgaaataagg

SEQ ID NO: 4028 - DNA, 492 bp, Glycine Max
atgcggcacaaacggagttctgcagagcggacacgtcttctgatcgtgatcgacccaacggtccacgcaccaccggtggaaaatgtgcttgcagttcgccatacaccggatttcttcttccgaggagaattcgctcaggcacacggcgcagcccgacggcggaggatccccgtcggcggctgccaggtcgcggaacgccgccacggggagaaactcgcggatgaggagggcggagagagtcggctcgcgtggcggaggcggcggagggaggtcagaggcggcggaatcggtgtcgaggaggtcggagatgcggaggaggcggaagagggcgaagacgagggagcgcagccacgcgaggagggaaagcgcgtggaggaacattttcggaaccagcagctccgggtaccctacgggaaaacccatcgtcgggcgcgtgagactatacgcgctttgttttttaagaaaaataaaataaaaatggatgaattttga

SEQ ID NO: 4029 - DNA, 1605 bp, Glycine Max
atgcggcttcgatttatttttgtgtttgtttcttcccctttccctcttctctgttttcaccgacccttgttttctatctgggtcggcaaatggttttcaattagtgtttctgtgttgtttcttcattgttgctttctctcgaagctagctcaacccgagatggatctgagagaaagtttggtacttcttcttgtggggtcgttcgtcgtgcaattttgttgcaatgccaatgcgaatttggtgttccccgttgtgcgcaaattcaaaggtcccgttgaaaacctcgctgctatcaaagctcatgatgctggtcgccgaggtagatttctctctgtcgttgatgtcgctcttggtggcaatggccgtcctacttcaaatgggctgtattataccaaaattgggcttggccccaaggactactatgtgcaagttgatacaggaagtgacactctgtgggtgaattgtgttggctgcacagcatgtcccaagaaaagtggtcttggggtggacttgaccctctatgaccctaacttatccaaaacttcaaaggcggttccttgtgacgatgaattttgcacttccacatatgatggtcaaatttctggctgcacaaaaggcatgtcctgcccatacagcataacttatggagatggaagtacgacctctgggtcctatattaaggatgatcttacatttgatcgagttgttggtgatctccgtactgtgcctgataataccagtgtgatttttgggtgtggttctaaacaatctgggacattgagttcaactactgatacatcccttgatggaataattggttttggacaagcaaattcttctgtgctttcacagcttgctgcagctggaaaggtgaaaaggatattttcacactgccttgacagcattagtggaggaggaatatttgccataggggaagtggtgcagccaaaagttaagacaactccattgttacaaggaatggcacactacaatgtggttttgaaggacatagaggttgctggggaccctatacagctcccctcagatatattggattcttcaagtgggaggggaacaataatagatagtggtacaaccttggcttatcttccagtctcaatttatgaccagctattggagaaggttttggctcagaggagtggaatgaaattatatcttgttgaggatcagtttacttgtttccattattctgatgaagaaagggttgatgatttatttccaactgtaaagtttacctttgaggaggggcttactctgacaacttatcctcgcgattacctattcctgtttaaagaggacatgtggtgtgttggctggcaaaaaagtatggcacaaactaaggatggaaaggaactaattcttcttggaggtttggtgctggcaaacaaattagtcgtatatgatcttgacaatatggccattggatgggctgattacaattgctcttcaagcatcaaagtgaaggatgacaagactggatctgtatatacaatgggtgcacacgatctttcttcagcttctaccgtgctaattggaaaaatattaacgttctttgtgttgcttattaccatgctaagcacttaa

SEQ ID NO: 4030 - DNA, 282 bp, Glycine Max
atgcgtgtgggtttgggtgttaaggtatcgttgggtgtgatcggtgtgagtctaatatttgcagtgctgaaaatgtcgcagttgttggacaaagccaaaaactatgttgcggagaaagtcacgaacatgcccaagcccgaggcgagtgtcaccgacgtggatttcaagcgcgtgagccgcgacagcgtcgagtacttggctaaggtctctgtttccaacccttattccactcccattcccatttgtgagatcaagtactccctcaaaagtgctgggagatag

SEQ ID NO: 4031 - DNA, 1332 bp, Glycine Max
atgcgtttttgcccgtgttttggatccgaggaggccaagggggtggcggatcgcgacccggtcctgctggtttcgggcatgggcggctccattgtcaattccaagcccaagaaattcgggttcaccactcgggtttgggtcagactcctcctcgctgacgtcgagttccgaaacaagatttggtccctttacaatccccaaacaggttacactgaaacgttggacaagaagtctgaaattgtggtccctgacgatgatcacggcctctatgcgatcgatattttggatccgtcatggtttaccaagtgtatacatttgacggaggtgtatcattttcatgacatgattgacatgcttgttggatgtggttacaacaagggaaccacactctttggatacggatatgatttcaggcaaagcaataggattggcaaggtaatggaaggtcttaaaagcaagttggaaactgctcacaaagcttctgggggaagaaaagtcaatttgatttcccattccatgggaggaatcatgatatcgtgtttcatgtcgctttatagagaggtgtttacgaaatatgtgaataagtggatttgcttggcttgccctttccaaggagccccagggtgcatcaatgattctttattaactggattagagtttgttgatggctttcaaagctatttttttgtgaaaaggtggactatgcatcaattgctagtggagtgtccatcaatctatgagatgttggcaaatccatattatgaatggaaaaagcaaccagaaattctagtttggcgaaagcataccaaggatggggacaataacatcaatttggaatcttatggaccaacccagagtatctctttatttgaagaagcactgagggacaatgaggtaaattataaagggaaaacgatatcactgccttttaactttgatatccttgactgggctgttgaaacacgtcaacttatagctaatgctaaactgccagatggagtctgtttctataacatttatgggacatcattggacacaccttttgatgtttgttatggttcggaaaactctccaatagaggacttatctgaaatatgccacacaatgccactatattcttacgtcgatggagatggaacggttccttctgaatctgccaagggtgatggacttgaagccactgaaagggtgggagttgctgcttctcaccgtggaatattacgagatgaaacagtgtttcaacatattcaaaaatggttgggtgttgagccaatggttggcaagcattctaaaacatcaaaagtggcagatgctcagcctatggttctatga

SEQ ID NO: 4032 - DNA, 942 bp, Glycine Max
atgctaaaatcagtcaatacatgctttcttagtcctaatcccttagatgaaaaagaagttgacgctgacccggttgaagcagaagcactgcaagcctttggcggtgtatgtcgacatggcagacatagacgtctgtcatgtcgaaaattccgcgtccatgcatcaccatggacgcgacaccaccatcctatcacccttgaacaaatgcttgctcattgtcgtgccgttgctcgtggcgccaagaggcctcttctcgttggagacttgccatttggaacctatgaatccaattccagtaaggcagttgatacagtagttaggatgttaaaggaaggaaacatggatgccataaaattagaaggagggtcaatttcaagggttgttgcagcaaaagccattgttgaagctggaatagcagtcatgggacgtgtgggacttactcctcaggccattagtgttttgggggcatttagacctcaaggaagaactgttgctagtgctatcaaggttgtggagatggcattggctttgcaggaagctgggtgcttttctgttgttgtagagtgtgtgcctgcacctgtggctgctgctgctacagcagcacttcagattccaacaattggaattggggctgatccattttgcagtgggcaggtgctacttttccacgatctgcttggtatgctgcaacatcctcatgctaaagattctttggtaaagttaagactccatcttttgcatactccaaaattttgtaagcagtatgcctgtgttggaaatgtaattaataaagccttattagagtataaggaagatgtgataaatggttcatttcgattgggtttggacaaggcagcatctgcagcatttgaagcagtccaaactatggatacttccaaatcaaacggtgaaggacaacaaaggactaaaacaacattttag

SEQ ID NO: 4033 - DNA, 825 bp, Glycine Max
atgctcaacctcttcactccacttccctgcctcgctgacgtagcctccgacgacgccggaaaaataaacctggaatcggtgctggtttccatcgacaacttcttcaatcggtacccgtttttcgtcgccggttgcacctttatttggctggtggtgattcctctggcggaagagtacttgaagaagtgcaagttcgtgtcggcgattgacgcgttcaggaagctccgcgatgacccgaatgcgcagctgctggacataagggacgagaagaacgtgaggtttctgaagtcttcgaatttgaaaatgttcgagaaggaagtggcgcaggtcgagttcgctgaggatgggaacgaggacgagtttgtgaagaaggtgttggggaggttcaaggacgcgcctaacactgttgtatgtgttttggacagttttgacggtaattccatgaaagttgccgaggtactgttcaagaatggtttcaaagaggcctatgcaatcagaggtggagttagaggccagcaaggttggatggctatacaggattcccttttgcccccttctgtgcatataaggaaaagggtaaaagcttcaaagaaactcaatacaaatggaaatggagccatccagcaaaatgatagtaacaataatagttccttaacccaagatagatcttctgttgaaaaccaaacaacagacgatggtcatgtgaaaagctctgtagagtttatttcagaagtgaaaactggttctgtagcatcctcctctccttatcccaattacccggatttgaagccaccatcatctccaactccgtcaaagccacaatag

SEQ ID NO: 4034 - DNA, 924 bp, Glycine Max
atgctcaggagcagcacgctaacacagagtgttacagtcacctgtgttcatcacagtcacagacaatggttccaatcaattcccgtaaattatagattctgtgacgctgctcggaactctctatcatccaactccgccatcttcaagtggaaaagaacggctaattataatcgtaaccgttctggaatgggaaccttcaccacgcgcgcgttggcgcagccgctccagaacgccgacgaactcatcgattccgtcgagacatttattttcgattgtgacggagttatatggaaaggtgacaaattaatagaaggggtgcctgaaacgcttgacatgcttcggtcaaagggcaaaagattagtttttgtcaccaataactcaacaaagtctaggaagcaatatggaaagaagtttgaaacacttggcctgaatgtcagcgaggaggagatttttgcatcatcctttgcagctgctgcatatctgaagtccattgatttcccaaaagataaaaaggtttatgtcattggagaagatggtatcttgaaggagcttgagcttgctggatatcagtaccttggtgggccggaagatggtgggaaaaagatagaactgaagccaggatttttgatggagcatgatgaagaggttggagcagttgttgttggatttgatcgccacttcaactactataaaatccggtatgggacactctgtatacgtgaaaaccctggatgtcttttcattgctacaaaccgagatgctgttactcatctcacagatgctcaagaatgggcaggttgcatttcaaccaaattagcagttcctagcaggctcacaaacctgaaaacagttcaacactatcaatacacggtgggggctcaatggttggcgctatcagtggatctactcaacgtgaaccattag

SEQ ID NO: 4035 - DNA, 813 bp, Glycine Max
atgctcctcagttactctctgcacctcccaattacatcttcttactcacacacctccaaccgcagtcccaactcgagcggttacataaagttccgaacaaggtaccgcgaaaacctgcgatacctgcgagccttaaccataatcgacccaaaaaccaaaccagaggaccttcctctccccaacgacgtcgaccacatcatcgacactctcacattcctcaagtcgcactctttctccgacgccgacatccctcgcctcaagttcctgacccctgagctcttcaccaccgccgtcgtcccctccgacgtctccgccgtgttccgcttcctcgccgacgacctcgccgccacgaaatccgagtcccgcgacctcatcctccgatgccccaaactcctcttctcacacgtcgacctctgcctccgacccacgctccaatttctccggcaggggctgaaccggccaacgacaaggaacgcgcacctgctgaacacgcgcgtagacaagctgcatgcgaaagttgagttcttgcaagagttggggttttcgtacgaggaggctgtcagggcttgtgctaggttacccgcaatttttgggtatgacgtggagaacaatttatggccaaagtttgtgtatcttgtcaaggaaatggagagggatttggaggacttgaagaggttccctcagtactttgggttcagtttgaaggagaggattgtgccaaggcacttgcatttgaaaaaaaggggtgttaggattcccttgaatagaatgttgatgtgggctgatcaaaagttctacgccaagtggaagtga

SEQ ID NO: 4036 - DNA, 2211 bp, Glycine Max
atgctcctcattactcactggtttctattggctcttcatggcagtgctgagacttccacatatatagtccacatggacaaatccctttttcctcatgttttcacaacccatcatgattggtttgaatccaccattgattccataaaatcagcaaaacttggtcactcatctaaccaatcacagaaactagtgtactcctataaccatgccatgtatggttttagtgctgtactaacattagaagagttggaggctgttaagaactctcatggctttgttgcagcatatccagacagaaatgtcaccatagacaccactcacacttctgaatttctctccctagactcttctagtggcctatggcatgcctcaaattttggggaggatgtcattgtaggtgttattgacactggtgtgtggcctgagagtgaaagctttaaagatgaaggaatgactaaaattcctaacagatggaaagggacctgtgaggaaggacaagacttcaacacttccatgtgcaacttcaaactaattggagctagatatttcaacaaaggtgtgattgctgcaaattccaaggtaaaaatcagcatgaactcagctagagacaccgtgggtcatggaactcacacatcatcaacaattgctggcaactatgttcatggagcctcttactttggctatgctaaaggggtggctagaggcattgccccaagagctaggcttgccatgtacaaggtcatttttgacgagggtcgtgtagcctcagatgttttggctggaatcgaccaagccattgctgatggagttgatgtgatttccatctctatggggtttgatggtgttccactttatgaggaccctatagcaatagcttcttttgcagcaatggaaaaaggggtggtggtttcatcttctgctggtaatgaaggtcctgatcttggtaccttgcacaatggaatcccctggcttctgactgtagctgcaggcaccatagaccgcacatttggtactctaattcttggaaatggacaaaccattattggttggaccttgtttccagcaaatgccttggtggaaaatcttccacttatctacaataagaatatatcagcatgtaactcagtcaagcttttatccaaagtggccaaacaagggatcattctatgtgactcagagtcagaccctgagttaaagatgaaccaaaggagttttgttgatgaagccagtttgttaggggcagtgtttatctctgatcaacctctattaaatgaagaaggacatgtttcctctccaactattgtaatcagctcacaggatgcaccatctgtgatcaagtatgcaaaaagccataagaagccaacagccaccatcaaatttcaacgaacatttgttggaataaagccagcaccagctgttaccatttactcttcaagaggtccttcaccaagctatcatggggtcttgaagcctgacataatggcacctggctctaatgttcttgctgcttatgttcctacagaaccagcagcaacaattggcaacaatgtgatgttatccagtggctacaatttgctgtctggaacatccatggcatgccctcatgcttctggtgttgctgctcttttgaaagctgcacacactaaatggagtgctgctgctataaggtctgcactagtaaccacagctagtcctcttgataatacacaaaatccaattagggactatggttacccttctcaatatgcttcccctcttgccattggagctggtcaaattgaccccaacaaagcacttgatccaggtttagtatatgatgccaccccacaggactatgttaatctcctttgtgctttgaagtacacacaaaagcaaatcctaaccattacaagatcaacatcttacaattgtgcaaaaccatcgtttgatcttaattacccttcatttatagctttctatcgcaacaacacaaggtcagttgttcacaagtttaggaggacagtgaccaatgttggagatggtgctgccacatacagagccaaggtgacacaaccaaaaggctctgtggtgacggtgtcacctgagacattaacattcagatataaaaatgagaagctgagctacgatgttgtgataaagtatagcaagtacaagaagaaaaatatatcatttggggatcttgtttgggttgaagaaggtggaacacacagt

SEQ ID NO: 4037 - DNA, 1551 bp, Glycine Max
atgctgagtgagatagattttgtggttgggctgggggattggagcgtttgtagtggagtcagtagagtagcactgttgtcagagcctggaacaatctctagtgtatttcaggatggtgccgataattttcaatcaaaagattatgagaccagtgcggaactctttgaaaaatcaatgctatatattccatatgatgcagagaacagaatacttcgagcaaagggctttagagttttgtgcctctgctaccttggtctcctgcagctggatcgcgctcaagaatacattaatgaggctgaaaagcttgagcctaacattgtctgtgcttttcttaagttcaaaatttatctccaaaagaatgaccaccaaggtgctattaatcaaattgaagcgatgacaacatgccttgactttcaaccagattttctctcactttcagcacatgaagctgttgcatgccatgctctacctattgctgttgcttctctatcaagtatgctaaagttctatgcttcaggaaagtccatgcccacagcagaagtaacagttgtgcgcaccttgctgacagtcctctctcaagagccgggtaacgaacagcaagtaataaaattcctcaaacacgcccatacacgagcatcggagattggtcctgattgcttctttggaaaagaggaagttggaagacgggaacggaattggtttgctgtgacttcatggaactttgggacaaaatcgggacaggataagaactatgaatcatctgccgtgttcttaaaactggcatcagatttttatgctctaattgaggggtctgataatgagaacaatgtcatggtttgcaaatcgttagtgctttctgtatcatcaatgatagcttcagaatttgaaaggaagacttcgatgtcagaaactgaagtcaagcaagctttatacttgttagatagagcaggggagttcctttctagtgaccaaattaataccattgagcctgaactttttttcatatacactttctgctattatgatatacaaggcaggctgaatgacttgggatctcaacttctcaatgtgaaaagctttgccagctcaaaggcttgcaaacctcaccacctccttcaaataggtctctctgcctcacagggaccacggttgaatcacgaagtagcctgctttgctttaaatgaatgcctctcatctttcctttcatcagcagctccagattatcaaaatgttgctcttgtaatgcgcaagcttatatccaatgccagcattcacaagggtgatgcagatgatgatcttgtatatagcatgtacaagcaagcctataggataatggttggtttgaaggaagatgagtatccgattgaagaaggaaagtggcttgccatgactgcatggaaccgagcagcagtgccagtcaggttgggtcagattgaagtggggaagaaatggatgactgtgggcttagacattgcaaagcatgtcccaggcatggaagcttacaaagaatgcatggaagaagtccttggcaatttgaagaaagaattttga

SEQ ID NO: 4038 - DNA, 834 bp, Glycine Max
atgcttccgagggcattattggccaaattcgttctcaaaccctccactgttgtttctccattccagttcaatcagcagggagcattgcatagtaggaacaagaaagccttggagttcattgcaaaaggctggaatgctttgaaggaggttgatagagtcatcgattattccgatcccaagcattcgggcattgtttctcttctcagggcagctaaggagaatttcgagcttgctttggaagctgataataccaatacccatgctaggtattggttgtccagattgcatatgaaataccctgttccaggagctaataaagctgtaggggcagcattattggtagaagcagcagaaatgggtgatcctgaggcacagtatgcattgggttgtcatctaagagttgagaatgactatgtccagtctgatcaacaagctttttattatttggagaaagctgtggaccagttgcatccaggtgctctttaccttttgggtgctgtatatttgacaggcgactgtgtcaagaaagatattgcttctgcattgtggtgtttccacagagcatcggaaaagggccatgctggggctgctatagcatatggatctcttcttcttaaaggtgttgaggttccagaatcggtaataaagttcagtttgacgagaggtgctgcagctcatagacgggggaggaataagggagctcttgcaattgatccagtagagatggcaagagaaaagtttcagatagcggcaaaagcagggtgtgagcttggattcaaatggcttgcaaggttagaggaggaagagaaacgggcactcacggaggaacattga

SEQ ID NO: 4039 - DNA, 771 bp, Glycine Max
atggaaaagaagcaccgagcgaagccagccaggttgtcttccgattccttcgtgcgtgcgattcttctgatattccaaggcgacgcaccgacaccggacccatctccggcgacatctcaccgatctccggcgaatccccggtccccactttcttccctcgaaatgaatcccgagtgtgattatctgttcaagctccttcttattggagactctggtgttggtaaatcatgccttcttctgagatttgcggatgattcgtacatcgagagctacataagcaccattggagttgatttgaaaatacgtactgttgagcaggatggaaagaccattaaactacagatgtgggacacagccgggcaagaacgatttaggacaatcaccagtagctactatcgtggggcccatgggatcattattgtttatgatgtgacagatgaagagagcttcaataatgtgaagcagtggctcagtgaaattgatcgctatgcaagtgataatgttaacaagcttttggttggaaacaagtgtgatctggaagcaaatagagctgtgtcatatgaaacagctaaggcattcgcagatgaaataggcataccttttatggaaacaagtgcaaaagatgctacaaatgttgaacaggctttcatggcaatggctgcttcaatcaaggatagaatggcaagccaacctgcaaacaatgcaaggcctccaacagtgcagatcaggggacagccagttgcacagaaaggtgggtgctgctcttcctaa

SEQ ID NO: 4040 - DNA, 579 bp, Glycine Max
atggaaagccaagacccaccaaacccaccaccccaaaacaaccccttcctcttcacgccaaattcgatgttgcaaagccctaatttggaccctcaagagcaattagggctatgtgacattgactggggtaaccttttctctgctcaaaacagcttcttgcttaatggggatgccaacgatgcaattgaatgtgcttcttcttcttcttttgtggctcaaaataaggtagcttgtgaagaggaaaagggaaacaaggagaaaaggaaaggtgggaggatgaagaaaacaacacgagtgccaaggtttgcgtttcaaacgagaagtgcagatgatattttggatgatggttatcgctggaggaaatatggtcagaaagctgtgaagaataacacatatccaagaagctactaccgctgcacgcatcacacgtgcaatgtgaagaaacaagtgcaaaggctatccaaagacacaagcattgtggtgacgacttacgagggaattcacaaccacccgtgcgagaagttgatggaaactctaacccctctcctcaagcaaatacagtttcttgccagcttgtaa

SEQ ID NO: 4041 - DNA, 342 bp, Glycine Max
atggaagtaactgagaaatgtgatgtatttagttttggagtgctttctcttgaaatcatcacggggaagcatccaggagatctcatttcttcattgttttcttcgtcttcatcagcaacaatgacttttaatttgctactaattgatgtgttagaccaaagactacctcaacctctaaaatcagttgtcggggatgtcattttggttgcaagcttggcattttcttgcataagtgaaaatccaagttctcgcccaaccatggatcaggtgtctaaaaagctgatggggaaatcacctttagcagaacagttccctgcgattagacttggacaactcttctag

SEQ ID NO: 4042 - DNA, 1281 bp, Glycine Max
atggaattcgatgccgcgattcccgtgtctcgagagcacttacctcaaggtgcaatgtggcaaattaacttgaggtcaagtgaaacaatggaatcagaaccttatcctgagcatccaggagaaccagattgttcatactacattaggactggcctttgtagatttggagcaacatgtcgatttaatcatcctcctaacaggaagctggctattgccgctgcaaggatgaaaggtgaattcccagaaaggataggacagccagaatgccaggactatttgaagacaggaacttgcaaatttggagccacatgcaggtttcatcatcctagagacaaggctgggattgctggaagagttgccttgaatattttaggctatcctctccgcccagatgaaccagaatgtggttattatttaagaactggacaatgtaaatttgggaacacttgcaaatttcaccatcctcaaccaaacaatatggtgctttccatgcgaagttctcctgtttatcctactgtccattctccaactacaccaggtcaccagtcatatgcgacaggaattacaaattggtctagttcatcgtatattcctagcccacgttggcaaggcccttcaagttatgcacctttaattctacctcagggaatggtttcagtgtctgggtggagtgcatacagtggtcaaatgggatcagacagtccacagcaaacaatggcaaatggccaaagctatggaacttctcgacaaagtgaaccagcaaattcaggatcccagggggcatattctcaatttcgttctggctctgttcctgtagggttctatgcgttgcagagggagaacatatttcctgagagacctgatcagcctgaatgtcaattctacatgaagactggagattgcaagtttggtgcagtctgtcgtttccatcatccacatgaaaggatgattcctgctcctgactgtgttttgagtcctataggtcttcctttacgtcctggagagcccctgtgtgtgttctattcacgttatggcatatgcaaatttggtccaagctgcaagtttgatcacccaatgggagtcttcacctataacatgtctgcatcacctttagctgatgccccaggacggcgtatgttaggttcttcatcaggaacttctgcattaaatttatcatcagaaggacttgttgagtcaggctcagcaaatccaaggaggctttcattatcagaaactcgacagataccttctggtgatgataacattgatgaagagggataa

SEQ ID NO: 4043 - DNA, 360 bp, Glycine Max
atggacaaggcttatgtgcttcgtgaagctgtcaattacacaaaacaacttcaagagcgagttaaagagttggaaaatcaaaacaaagtagattcagcaacattcataaggaaatctcaagcttcctcacattgtgaaacgaacaaagaaatatcactatttgaggttgaagcaagagtcttagatgaggaagtactcattggaatccattgtgagaaacaaaaggacatagtgttcaaaatacatgccttgcttggaaagctccatctctctacaaccagtagcaccgtactgccatttgggacttctactcttataatcaacattattgctcagcgttattatgaaagtcatatctag

SEQ ID NO: 4044 - DNA, 2319 bp, Glycine Max
atggacagctccatttttcgccttatagtttcgtcgtgtcttctttttactttcctgctggaagctgttcatggcagcaaaaagtgttacattgtatacttgggagctcattctcatggtcctagccctacctctcttgacctcgaaatcgctacccattctcattatgatttactagcttcagtcttgggaagtgaggagaaagcgaaagaagcaattatttactcatataataaacacatcaatggcttggctgcgctacttgaggaggaagaagcagcagatattgcaaaaaacccaaatgtggtgtctgtgttcttgagcaaaaaacataaactgcacacaactcggtcttgggaatttcttggactagaccgaaatagtaagaactctgcatggcaaaaggggagatttggcgaaaatacaataattggtaacatcgacacaggtgtttggcctgaatccaagagcttcagtgataatggatttggctccgtcccatcaaaatggcgagggggtaacgtttgtcaaattaacaaactccctggctccaagagaaatccatgcaacaggaagctgattggagcaagattctttaacaaagctttcgaggcatacaatgggaaacttgatccatctagcgaaacagcacgtgattttgtggggcatggaacccatactctatcaaccgcagggggaaattttgtcccaggagcgagtgtatttgccgttggcaatggcactgcaaagggtgggtcaccaagagctagggttgcagcttacaaagtgtgttggtctccaactgatcctgcaagttgttatggcgctgatgtgttagctgctattgaccaagccatagatgatggcgttgatatcatcagtctttctgctggtggaagctacgttgtgactccagaaggaatattcacagatgaggtttccattggggcatttcatgcaattgctagaaacagaattttagttgcctctgcagggaatgatggacccacacctggaactgttctcaatgtggctccttgggtcttcacaattgctgctagcacattagacagagactttagcagtaatttaaccatcaacaataggcaaattacgggagccagtcttttcgtaaatttgccacccaataaagccttttctctgatccttgcgactgatgctaagcttgctaatgcgacatttcgagatgctgaactttgtaggcctggaacacttgatcctgaaaaagtaaaacggaaaatagtgcgttgtattagagatggaaaaataaaatccgttggcgagggtcaggaagctctatctaaaggcgccgtggcaatgcttttgggcaatcaaaagcaaaatgggagaacccttcttgcagagcctcatgttttgtctactgtgaccgacagtaaaggacatgcaggggcacagcctggttacataactgccataatgtccccagcaagaacattatttggaagaaagccagctccagttatggcttcattttcatctagaggacccaataagattcaaccatcaatactcaagcccgatgtgactgcgcctggtgtgaacatacttgctgcctattcagaattggcaagtgcatcgaacttgctagtagacactcgtcgagggtttaaattcaatgtattacaaggaacttctatgtcttgtcctcatgtcgttggtattgctggacttatcaaaacacttcatcctaattggagtcctgcagctattaaatcagcaatcatgaccacagcaaccacacgtgacaacacaaataggccaataaaggatgcgtttgataataaagtggcagatgcctttgcatatggttcaggacatgtgcaaccggaccttgccatagatccgggacttgtttatgatctaagcctcgctgattacttgaactttttgtgtgcttccggatacgaccaacaactcatctccgcactcaatttcaatggcacattcatttgtaaagggtctcacagcgtaacagacttgaactacccttcaatcacattaccaaatcttggcctaaaacccgtaaccattactcgcacagtcacaaatgttggaccaccagccacatacactgcaaatgtccactcgcctgctggatataccattgtcgttgtgccaagatccttgactttcacgaaaattggggaaaagaagaaattccaagttattgtgcaggcaagcagtgtaactacgcggagaaagtatcaattcggggatttgcgttggacagatggaaagcatatagtaaggagtcctattacagttaagcgcagatga

SEQ ID NO: 4045 - DNA, 801 bp, Glycine Max
atggacgatagaggcggttccttcgtcgccgtgagaagaatttcgcagggtcttgatcgaagcaacacgtgccattcaagttccgctgagtttgtgacaggatcaacagcatggcttggcagaggtctgtcctgtgtctgtgcacagagaagagaaagcgatgccagaccctcttttgatttaactccggcccaggaggagtgcttgcagaggctacagaatcgcattgatattccatatgatggttctatccctgagcaccaggatgccctaagagctttatggagtgctgcatttcctgaagaagaactccatggtttgatttctgagcagtggaagaacatgggctggcaagggaaggatccatcaacagattttaggggtggtggtttcatatcattggagaatttgttgttttttgctaggaatttcccggaatcttttcaagaccttttacggaagcaggaaggagatcggtcagtgtgggaatatccatttgctgttgctggtgttaacatcacattcatgcttattcagatgctggatcttgaagcaggcaaacctcggacactggtgggagcaactttcctaaaatttcttgcaggaaatgattcagcttttgatcttctctattgcataacattcaagatgatggatcaacaatggctttctatgcgtgcttcatatatggattttaatgcagtaatgaagtctactcgccgtcagctggagaaagagcttctgcttgaagacataatgcggctagaagatgtaccctcatacaaacttctcacacgatag

SEQ ID NO: 4046 - DNA, 2259 bp, Glycine Max
atggagagggttgcagagccaaaggtacttcctcggtccttgcctgttctagttgaggtatctaatggacacaccgctgcaataagagaagctgcaagagaagggaatcagttttcaaaatcacgggatggccctatggcacgtcttgcctccatcagagaagtggctcagttatcgaatgcacgaatagttttggtaagagaggatatgggattcgatacacgctgtcaagagcctccctcccctgtgcctgtgcctacaagaacatggaaaggaaagggctctttaccagaagctgtagaacttgtgtctgatattgagaaattgaagggtagcaatgattcttttgtggaaactggtccaagttcatttgctggtgctagtcatcccccagaacctgttgatactgatcttatgagaacagtttttgtaccaataggtcaaactaaatctgaagctggatgcttaatgaagagcgtgtccttgaagggtcctttcttagaagatctttcaattcgtgttcttgcaaagaaaccaagcctggctgttgtttctcctgcagaaatcatggctgaggaatcaaatgagatgggtaacttatcctcaccattttcaggtgctcgtgcatcacagaatactgagaactctccccttgccccagactctgatgagaaagaatgtgtttgggatgcatcattgcctccaagtggcaatgtcagtcctcatagtagtattgatagtactagtgttgtcagaacaatgagcattgttaatagttgtgcaagtacataccggagtgatgcagttactagtgatggaatgcttagtttggacaggaattgtgatagcactaaaggaagtgtaagaggggattcacttgagagtgcaaaaactagtgctagtcgagcaagtgacagcagtggcctcagtgatgacagcaactggagtaacattactggcagtgccaataagccccacaaaggaaatgatcctaggtggaaggctatccttgccatccgagcccgggatggaattttgggcatgagtcattttaggttactcaaacggcttggttgtggtgatattggaagtgtatatctctcagagctgagtgcaactcggtgcttttttgcaatgaaagttatggacaaggcatccttagcaagcagaaataagctgactagggcacagacagaaagagagatattacagttgctggatcatccatttctacctactttgtatacacattttgagactgacagattctgctgtttggtaatggaatactgtcctgggggtgatctacacactttaaggcaacggcaacctgggaaacatttctcagagtatgctgcacggttttatgctgcagaggtcctgttggcacttgaatatcttcacatgcttggagtcgtgtatcgagaccttaaacctgaaaatgtactggtccgagatgatggtcacataatgctctcagatttcgatctttctctcagatgtgctgtttcacctacccttattagaaattttgacagcgacccctcaaaacgaggtggtggtgcattctgtgtccagccggcatgtatcgagccttcatcagtatgcatccagccttcatgttttatgcctcgcctctttgctcagaaaaataagaagtcacgaaagcctaaaggcgatcctggcttgccatccagcacgcttcctgagcttgttgcagaaccaacaacagctcggtcgatgtcttttgttggcactcacgaataccttgcccctgaaatcatcaaaggagaaggtcatggaagtgcagttgattggtggacatttggaattttcttgcatgagctattatatggtaaaactcctttcaaaggatcaggaaaccgtgcaacactgttcaatgtagtgggccagcagctcagatttcctgaatcgccggccacaagttatgccagccgtgatctgatccggggcttgctggtgaaggagccgcagcaccgtctcggggtgaagagaggcgcgactgagatcaaacaacaccccttctttgaaggcgtgaactgggcattgattaggtgcagcacaccacccgaagttccaagaccagttgaatttgatccaccggcaaagtttgaaccagttgatactgttggggttggcaacaacaacatcaacaacaacaatagtagtaagaggatggtgggtaataataatgacatgaagtctgggggtaaatatctggactttgagttcttttaa

SEQ ID NO: 4047 - DNA, 850 bp, Glycine Max
atggagctttttcacaacctcaacattttcagcacaattctgctcctatgcatgtttcctcactcactcaagtgccaacaagcatacctcaatggcactgtctatgactgttctgataacccttcagcaccaaaagggtatctttgcaatggccttcagaagtcatgcacctccttcttacttttcaggtcaaaacctccctatgatagccctgggataattgcttaccttcttggctctgaggcatctaccatagcctcaatcaacaggatctcaagaaatgacaagattccttccaataagtcaatcattgttcctgtgttctgttcatgttcaggaaacatctaccagcataacacaccttacactgccagcaagaatgacacctactatgagttggtaaaagaaaccttccaaggcctcaccacatgtcaggctatgatgggtcagaattactatgcttcaatcaacattgcaattggtgctgagctcacagttccaatgttgtgtgcttgtccaactgaaaatcagacagcaagaggggtcacctctttgctggttcacttggtgaactatggtgacactattaagtccataggaagggcctatggtgtggatgaacaaagtgtgctagaggccaataagttggcagtttcacaaagtaaaaacagcagcatggacctccttgccttgacacctattatagttcctctaatagggaagagctgcaaagagaacccagataaattctattgtagatgttaccaagcaccagatggaagctccaaggggcccttctgtgatgaatctgatggtcagaaattccctgccaaattggttgctggtttag

SEQ ID NO: 4048 - DNA, 1896 bp, Glycine Max
atggaggaagagagagacgtgtcatcggatgagttatcagaggagaaatatgacccagtggaggagatccaaagagtcatccaatccatagttcaattcggcgagtaccggaggacacagaggaaggagagccacaacctcgtgcgccgtttcaagctcatgttgcctctctgggaagagcttcgtgacctcccacaacccttcccagaaatcggcgtcacttggttatccaaagtcaaggatgtgcttttgttcgccaaggatttgttgaaactatgtagccaaggaagcaagatccacctcgctttggaaaccgaggtagttatgatcacgtttcagaaagtgtatgacaaattaagccaagcgtttggtgatgtgccttgtgatgaaatgggtatctcagatgaagtcaaggaacaacttgagctaatgcacgtgcaactcaagcgagccaggagaagaactgatacacaggacatagaacttgcaatggatatgatggttgtgttttctgataatgatgacagaaatgctgatagtgctatcattgagaggctggctaaaaagctggagcttcatagtgttgaggatctcaatatagaaacattggctattaggaaccttgctgcagaaagaaaagggcaacaggctgagagcactcagaaaataatttaccttcttaacaaattcaaacgaattgcaggcatggaagaaaccggcatccttgatgatcctgccgcacccaagatgcttgagaggtgcacctctttggtcatccctcatgagtttctctgcccaattacactagaaatcatgacagatcctgtcattgtaacaagtggacagacatatgaaagggaaagcataaagaagtggttccaatccaaccataacacatgcccaaagaccaggcaacctttggaacacttgtcattggcaccaaaccgtgccttgaaaagcttgattgaagaatggtgtgagaacaacaacttcaaacttcctaaaaaatacaattcttcaggtccagaaagctgtcctatagacagcaaagaggaaattccagctttggttgagagcctgtcatctattcatttagaagagcagagaaaagcagtggagaagatacgtatgctatcaaaggaaaatcctgagaacagagttttggttgctgaacatggaggaataccacctctagtgcaacttttgtcctatccagattcaaaaatacaagaacatgcagtaacagcacttttgaatttatcaattgatgagggtaacaagagtcttatatccacagaaggtgccattccagctatcatagaagttttggagaatggtagttgtgtggctaaggagaactcagccgcagctttattcagcttgtcaatgcttgatgagattaaagagattgttggtcaatcaaatgggtacccgcctttggtggatttgttgaggaatggaacaattagagggaagaaagatgctgtgacagctctttttaacttatctatcaaccatgcaaataaaggtagggccattagagctggcattgtgacacccttgcttcaattgctcaaggacagaaacttgggcatgattgatgaggctctctccattttgttactccttgtatcaaattcagaagcaagacaagagattggacaacttagtttcattgaaacccttgttgagttcatgagagaagggagtccaaagaacaaggaatgtgcagcatctgttcttcttgagttgtgctcaagtaactcatcctttacattggcagcacttcagtttggagtgtatgagtatttaatggagataaaacaaaatggaacaaatagagcacagaggaaagcaaatgcaatcttagatctcattagcaggagcgagcaaatt

SEQ ID NO: 4049 - DNA, 495 bp, Glycine Max
atggaggattcgttggagaattggatttcactgttggaaatggaagaatatcatgatgggtcatttgatgaggaagagttcctaagagagatccttaaggaggagcagcagccagaaaatttgtggcctcaaagagatcaaaagctctccaacaccagccccactgtgtcctttgatgaggcaattagcttttgtgggagtggcactctacataaaagcaacagctccaactccatcaagtctttgaaaagatcatcatcaagtgtctcaccagccaccactacataccttctttcttttgatacctcaagtgctaaaccaatcacacttaaaccttcccctaagcttgatttggcacttggatcatccaataaaaggagtactagtactgtaactgtggtgaaagatgggtgtgaatttgaaccattgatgatgccccaaagccaagcaaggaagaaggttagaaggtcatggttagtacttctgttattatga

SEQ ID NO: 4050 - DNA, 699 bp, Glycine Max
atggaggggctcaaggtctccaaagcgaacttaacagtatacattcacccttccaaaagtaaccaagtttcccaagccgttctccgccaactcagctctttgcttttcacgttcagcgaaatcttcgacggcgtcgttttggcctacgatgtcaattccttcgacacgtgcgcaaagatcctctccggcgttcacccttacttcggcgtcaaactcaaggtcaatctgttgctcttttctcccaagccaaacatgctcttaggagggaaggtggttaaggttacgcaagagtccattcacgttgttgtgcttggcttttcctctgcgattatatctgagaaagatatcagggaagagttcgtgtgcaaaacggaacgagggcaagaggtgtatgtgagcaggtctcacaagcggcatgtgataaaggtcgggaccatgatacggtttttagtcaagaggtttgatgaagaaatacttcatgtttatggatctctggttcctgatcacacaggcagcatttattggttggataagaacttggaagttgattcccattctgacaggagtgaaaagaagagaagaattgtgccagaacgaataatgctagagcaagatgctgtggatggggaattgtcaacgttgaacattggccaaaagagcaaaaaatcaaagaagcaaaagcaccaggaggaatcttga

SEQ ID NO: 4051 - DNA, 876 bp, Glycine Max
atggatccctctgcggcattgctatttaaccacctcaagggtgcagacccgttcttcctgctagcgggtcctaatgtgattgaatcggaggagcacattctgcggatggctaagaacatcaagagtgttgcatctgaggttggaataccattggttttcaagtcaagctttgacaaagctaaccgaacatcatcaaaatcatttcgtggcccggggatggctgagggattgaaggtactcgagaaggtaaaaatagcttatgacattcctatagtgacagatgtgcatgagaccatccagggtgaagcagttggcagagttgcagatatcattcagattccagcattcttgtgtcgccaagcagatcttctagttgcagcagccaaaactgggaaaattatcaacattaagaagggccagttctgtgctccttctgtgatgacaaattcagctgaaaaggttcggttagctggaaatcctaatgtgatggtttgtgagagaggaacaatgtttggatacagtgatttgattgttgatccacgtaacttggagtggatgagagaagccaattgtcccattgtagctgatataactcactcactacaacagcctgctggaaagatggtggatgggggaggtgttgctagtggaggtcttcgagaactaataccttgcattgcaaggacagcagttgccgttggagtggatgggatcttcatggaggtgcatgatgatccactgaatgcacctgttgatggcccaacacagtgggctttgcgccactttaaggagctacttgaagagcttgtagccattgctggggtaagcaaagggaagcaacggttcaacattgatctcacaccatttcgtgaataa

SEQ ID NO: 4052 - DNA, 618 bp, Glycine Max
atggatcgtgtcagccataggggttcacggtttcttctcgatgcgtctccgctgttagagttggagttccaacctaccatggatcctgtcatcaattgggtttcaaactttcttcacagtcttcagcattgcatggatcctgtcatcaactggctcatgtccctgataagttgcttagcgacaaagattaatcaaatacttgaaaaattcactgggcatcaatttaacgttaagactgacgcttgtgatgaaatttcattgggtggagaatggttgttgtatgttgctattgctgttgttgtagcactggcagctattcctgttgtctggttgctttggaaggtggtttttggtgttgtttggttgctttggaagctgatttctggtgttgttttgttgctatggaacgtgatttctatttttgtattgggtctttggaacgtgataaggaagattttctgttgttgttgtgaaagagggaagacaatgaaggctccagggaggaatattcgcatttatagagatgattttgaacgtagccctaagaactacttccgtaacttgcgcagagaccaacgtaactggcgcaataatcaacctcatacgattttggtttga

SEQ ID NO: 4053 - DNA, 396 bp, Glycine Max
atggatgacttgtttgattcttcgctgaacttggaggacacccattacaaggaaggctatgacgaaggctacagccatggccttgtcactggcaaggaagaagctaggcaggttggcctcaaggttggctttgaggttggcgaggagcttggtttctataggggttgtgtcgaaatctggacttctgcgatccggctcgacccaacctgtttctctccacgggctaaaacatttatttgccagatggaggagttgatccagaaataccctctcatggatccagaaaatgcacaagtgcaagagatcatggatagcctcaggctcaagttcaagatggcttgttcttccttgcatgtcaaacttgagtataatgggtatcccaaatcttctacggag

SEQ ID NO: 4054 - DNA, 1245 bp, Glycine Max
atggatgcgatacggaagcagctcgatgtgttgatgggagcgaaccgtaacggcgacgtccgtgaagtcaatcgcaagtactacgatcgcgacgtctgtcgcctctacctcgtcggtctctgccctcacgaactcttccagttaacgaaaatggatatgggcccctgccctaaggtccactccttgcagctccggaaagaatatgaggaggcgaaagcaaaggggaccgataattatgacagggagttggaggatgttatagacaagcttattggtgagtgtgacaggaaaatagggagggctctaaagcggctcgaggatgacgatgcgaaagctgcgattgcgatttcggtctctgaagttactcaaacagatgaggtgcttgagttgtcgaagcaaatcaaagagaaattgaaagaagctgatcaatatgatcttgaaggcaagtcagatctcaagattcgagctttagaggttgtagaggaacttagaactaagagagcggacaagcagtctatgcttcttttagatgccttcaacaaagatagggcatctttgcccacacctctgccaaatccaccacctttggcacctcttcctgtagttgctcctgatgctcgaacacaagagatgataaatgaaaagctgaagaaggctgaggatcttggtgagcaaggaatggttgatgaggctcaaaaagcactggaagaggctgaagcacttaagaagcttcctgccaggcaagagccagtgttggattcttcaaagtatacggcggcagatgtccggattactgatcagaagctacgtgtgtgcgacatttgtggagcatttttgagtgtttatgacagtgatcgccgtttagctgatcattttggaggcaaactacatttagggtatatgcagattcgcgagaagttagctgaacttcaagaagaaagaaacaagagccgaaagactgatcggcttgatgacaggagatcaaaagaacggagtagggatcgagacagggagtcgagtagggaccatgaacgtggtgatagtcgtgaacgagggcgagaccatgatcgtaggagcagagatcgtgataggcattatgatagagatcgtggatatgatcgcgaccgtgacagagactcagaccgcacccgctcctatgactcaagaagccgtcggaggtcacgctctagatcccaagagcgatctagagattatgatcgacataggcgtcatgatcgatactag

SEQ ID NO: 4055 - DNA, 2073 bp, Glycine Max
atggatgtagaagcggtgaaaaggtctccttctcaagaaaaatatggcagggttcaatctgcaataaggttgttagtgctggttgtgtttctgggttggattttcgtatggatagtgactccaacaaacacttaccaacaaaaatggcagcctcggcttcaagcaaagactaattctatttttggtgcacaaggtgcaatgcttctggtatacacttttccaatcttgttcatagctgttttgggatgtgtgtacgttcacatagccaaaaaaggaaacggtttcggcaaggaaagctgcagtagttatggcaagaaacgtgaggaattgaacaccttaccagtccaagtcacctgtacttggatcaattatgcatatgatccggtacgtctcactcgatatgatctagtcttgaactcctgggagaagaaactagatattgcatctgtgaggttggccctagttgggaacatatgcttggcattcctgtttttcccggttgctcgtggttcctcagtgctacctctgcttggactcacaccagagagttgcatcaaataccatatttggctaggaaacgtggccatgacccttttcactgctcatggtatttgtttcatcatctattggacagttaccgataaactttcaaagatgctagaatggaaaaaaactgggatatcaaatgtagctggagaggttgctttgcttgctggtttgtgcatgtggattgcaaccatccctcgcaataggcgaaaagtttttgagctcttcttctacactcactacctctacaccctcttcattgtcttcttcatctttcacgtgggcattttctatgcatgcactattctccccggtttctacctcttcttggttgatcggtacctaaggtttttgcaatcaagacgccgagttcgtttggtttctgctcgtgttttaccatgtgaaactgtagaactcaacttctccaagagccatgatttgacttataatcccacaagtattatgttcataaatgtaccaagtatatccaaacttcagtggcatccatttaccattacttctaatagtaatttggagccaaaaatgatgagtattgtcattaaaggtgaaggaacttggtcccagaagctctaccagatgctttcaaccccttctgcaattgatcatctcaatgtctcagttgaaggtccctatggaccagcatcaaccaattatctaaggtatgacactattgtgatggttagtggagggagtggaatcaccccttttatatccatcatccgggagctattgtatttgaacacaacattcagatatagaaccccaaaagttatcctaatttgtgcattcaagaactcttactatctctcaatgctagacctcatccttccaaattctggcaccccctatgatatgtccaacatgcaactacaaattaaggcttacatcacaagaaaggaggagcatagattggaaaaccaaattcaccttcaacaaatatggttcaaacccaaggcaacagatgcacccatatcagctattttaggtccaaacaattggctttggctttgtgctataatctcgtcctcgttcataattttcctcatcttaattgggatcattacccgattcatcattttccctatagaccataattctaataaaatattttcacaacctttgaggtcattcctcaacatttttgcaatatgtgtgtccatatcaatggcagctagtgcagctgttctttggaacaagaaatacaacgacagagaagcaaaacagattcagaacttagaaggatcatcatcagcagaatccccaaagttgaatactgatgaaggagataaagaactggaaagcctcccacagcaatcccttgttcaagctacaaaggtgcattatggagcaagacctgatctaagaagactgctattggaacttgaagggtcaagagtgggagtttttgtttctggacccaagaaaatgaggcaagaggttgctgccatttgctcatctgatttaggagaaaatctgcattttgaatcctttagctttaactggtag

SEQ ID NO: 4056 - DNA, 1125 bp, Glycine Max
atggattcattcagtgcaacaacggaaagacagctattgcttcacatgaatggtggcaagggagaaaggagttatgcaaacaacagcttgctacaaaaaaaactaatgcttaaagccaaacccatacttgaagaaactataatgaaactgtatcatgattcttctccaagctgcatgaaagtggcagatttaggttgctctgtaggaccaaattcacttcttgtgatatcaaatattattaacattgtcgataccacatgcaccatcttgaattgtgaaccacccacattccaattttatctcaatgatttatttggaaacgatttcaataccatcttcaagtcacttcctgatttccatacaagattggtagaagataaaggacacaagtttggttcatgctttattaatgcaacccctggatccttctatgggaggctctttcccagtaattccatagacctatttcattcctccaacagtctacactggctttctcaggatccattattggggttgactaaggaggcagaatcgctttacaagggccattgtcacatagttagcacaagccctccagaggtatacaaagcttaccttaagcagtttcaacaagattttaaattgtttctgaaatcacgttcagaggaacttgtgcctggaggagcaatgctcttggtggttctcggcaatcatgaaactccaagaagaaccggttgggaattaattagtctaatactcaatgacatgttcttggagggtttgattgaagaagaaaaattgaactcctttaacataccagtgtatgaacctacagttgaagaaattaggcatgttattcaagaagaagggtcattctttgttcaacgactagagattttaatcttgccttgggttgaaggcataaatgaagctggtgatgattcttttcttgatggaaatataaaagccggattaatggccaagcacgtaagagcagcaatggagcctctcctttccacaaagtttggtgaagaagttataaatgaagtattcatcaggtatcaaaagaaagttgtgcaactaatggaggtggagaaattagagtgtgctacttttatgatatccatgaccaaaaatgcttga

SEQ ID NO: 4057 - DNA, 1347 bp, Glycine Max
atggatttgaattcctctccttccaacaacacaattgccgtgaatggaacaatccccgtcgcttccacgttcgcaaccgccaccgcgccgtcggataaccctccgccggcggacagctccggcgaccggaaacccatcgccctgtggccggggatgtaccattctccggtgaccaccgccctatgggaagctcgcagcaatattttcgagaggcttctggaccctcccagggacgctcctccgcagagtgaattgctcacgagaaccccctcgcagagcaggaccagcatcttgtacaacttctcctctgatttcgtgctcagagaacagtatagggatccctggaatgaggttcgaattgggaagttgctcgaagatcttgatgccctcgctggaactatttccgtcaaggattgttctgatgaagctagcacaacaaggccacttatagttgtcactgcttcagttgataagattgtactaaagaagccaattagtgttgacattgatctcaagatagttggttttgttatatgggttgggcactcttcaatagagattcaactggaggttactcagtccaatgaagggggcaatgattcagactcagtagcactgacagccaacttcatatttgttgctcgggactcaaaaactgggaaagctgctccggtgaatcgactttcaccagaaaatgctcatgaaaaacttctgtttgaacaagctgaggcaagaagtaatttgaggaaaacgaaaagaggaggggaaaagagggactttgagaatggggagaaaaataggcttcgggccctattggctgaaggaagaatcttctgtgacatgccagctttagcagaccgaaacagcattcttctaaaggataccagccttgagaatgccttaatatgccagccacagcaaaggaacatccatggtcgaatatttggaggtttcttgatgcatcgtgcatttgaattggctttctcaacagcatatgcctttgctggattagctccttgctttcttgaagttgatcatgttgatttcttaagacctgttgatgtaggggactttttgcgtctcaaatcttgtgttctgtacacggaggttcacgatccagatcagccacttatcaacgttgaagttgttgctcatgttacacgacctgagctgcgtactagtgaggtatcaaatactttccacttctctttcactgtccgtccagaagccaaggcgatgaaaaatggatttaaacttcgcaatgtagtaccagcaacagaggaagaagcacgacgtatattagagcgcatagatgctgacaacttgaatgaattcttcagagcataa

SEQ ID NO: 4058 - DNA, 162 bp, Glycine Max
atggatttttcctttttcattggatgccatggtgtcactatcttcccaattgctgaaggtggaagtacttctgcttgtggccactccaacaacggaattcctggtgtttttgctttagtggcttctgatctgttcttgctggcttggataattgggcggtga

SEQ ID NO: 4059 - DNA, 948 bp, Glycine Max
atggcaaacaatgaggatggaagggataagactactcgtgggaatgaatgggaggttgtatctctgacagcatcgacatatgcagctgctcctggtcctgatgaagttgagatgaaggatgatgggaacgaagatgtatatgggcaagatgaaggagaaacgtcaaatgctttatttatgtctcgtcactttgtctttcctcccagtcagcatgaaaacttgcccgtggaacctgactatggtgagattcatgatgattctggagacaaagatgttgcctctgaagagactcctgaagaagtgaccataccaagtggaaaggatgaagaaaacttgacattaccaggattggaagtttcagaggagtttgagggcatgcggtattttgacgagaaaatcaacagattatctgttcgtggtaaacagtttgaggaaagtacaactctaccagcatttggtttgactgaaaagggggagagcatgtatgaccctgcaaaatacacttcttttgacagtgaaactgctattggtggcataacagcttatggtgaaagcatagttgatcctgaaacaactgaatccgcagagcaagggtcaaacgtatctcctgatctatcattgtcaaactactcttccaaagataatgaatacaactcctcagatcttccttgtggagcttggtggaagcggagagctgcctccttatatgctcatgcaaaagaggcaaatgcattctggtctgtcttcattgcagctgctgtgatgggtcttgtaatgcttggtcaacgctggcagcaggaaagagctttacaacttaaatggcaaatcagtataaatgatgaggcgaggagcagggtgcttgctcccatatatcgactcaaagatgtgattgttggtggcaaccgccgtggctccttgatcaggggaagctcctctggtgaaagttaa

SEQ ID NO: 4060 - DNA, 591 bp, Glycine Max
atggcaaattatggaaccacacagagaattcccacctcctcaacaccacaatccaccgctgacacttatgaaccagaaccaaaagcaccccatgaaaagttctacagtgatttcagaatctactgccccattaacataccctcaacatcagaagctgcaggggtacgtatcatgagaaacatgtgcaatttcggattgtactacacactctttgtgtggatcatactcttcataaccctcatccctcagcgtaaggtgtcattgattctgtttgtcatcatgacctatgtgacaaccctttattttttactcttgagggcatttccaaactctgttgtgcttcacagaatcatagacaaaagagttgtgctggctttgctagcaattgcaactgcagtgcagctgattttgactaaggcaggtatacatcttgcagtgactttggctagcagtgtgcctgtgcttttggttcatgctgttctgtgggctagttatgatgcctttgaggttgaggattcttctgctaaaggggaactggctcctcttgctggccatagtgaaagtgttgctgacaattctgatgctgtttaa

SEQ ID NO: 4061 - DNA, 1113 bp, Glycine Max
atggcaaccacgaacccttttgatttgttgggtgacgacgctgaggacccttctcagctcatcgccgccgagcaactcaaggcggcggctgcggcctcggcggccaccgcggctcccaagaaggcgccggctcagcagaacaagccggctcagctccctaccaagccgcctcctccggctcaggctgtgagggatgccagaaacgagccagttcgtggaggccgtggaggtggacgaggtgggggacgtggatttggacgtggtcgtgggtttagtcgtgactcctcgaatgatgagaactcattccctaccagcagagctccttataatcagggtccttttgaagaaggagatgctgggaagtcttctgaaagacgcagttatggtggaccacgagttccttaccgtggtggtcgtcgtggaggtttcagcaatggtgaaactggtgaaggtgaagacggacgacctcgaagagcatttgatcgtcgcagtgggactggacgaggaaatgaattcaaacgtgaaggttcaggacgaggtaactggggaacccaaactgatgaacttgctcaggtaactgatgaggttgtgaatgaaacggaaaagaatttgggtgatgagaagcctgcagttgaagaagatgtagctgatggaaacaaggacagccctactaatgaaaccgaagaaaaagagcctgaagataaggaaatgactctggaggaatatgaaaaagtgttggaagagagaaggaaggccttccaagcactcaagactgaagagagaaaggtggacactaaagagtttgaatccatgcaggccttatcaagcaagaaagataatcatgacatattcattaaactgggatctgataaagataagcgaaaagaggcttttgagaaggaagaaaaatccaagaagtccgtgagcatcactgagtttctgaagcctgctgagggggaagcatactataacccagggcgtggtaggggtcgtggccgtggttcacgaggtggaggcggaggcggaggtgtttaccgtggaagttccaccaacaatgcacctgctccatccattgaagatcctgggcatttcccaaacttgggtgccaagtga

SEQ ID NO: 4062 - DNA, 906 bp, Glycine Max
atggcacattcctcgatcgtcgttactctgagccagaacttgtttaaaaggaacctcacctgtgtaaaaattcacgctcattctccttcttcttctttcggatctcgttctctttctcttccttccttctccttctctcagagaacaactcctctctctctcaccgcctccttctcctctcacaccgccatgggcgagacttccgctcccgccgctgatgccggcatggacgccgtccagcgccgtctcatgttcgaagacgagtgcattttggtggatgagaatgaccgtgtggttggtcatgattccaaatacaattgtcacttgatggaaaagattgaagctgagaatttgctgcatagagctttcagtgtattcctgttcaactctaagtatgagttgcttcttcaggaacgatctgcaaccaaggtaacattccctcttgtgtggacaaacacctgttgcagccatccactgtaccgtgaatctgagcttattgatgagaatgcccttggagtaagaaatgcagctcagaggaagcttttggatgagcttggtattgttgctgaagatgtaccagttgatcagttcaccccattgggtcgcattctttacaaggcaccttctgatggcaaatggggagagcatgaacgggactatctgcttttcattgtccgggatgttaacgtgaaccccaatcctgacgaagtggctgatatcaaatatgtgaactgcgatcagttgaaggagctgttgaggaaagctgatgcaggtgaggaaggtctgaagctatcgccatggttcagacttgttgtggacaatttcttgttcaaatggtgggaccatcttgagcgaggaactcttggggaggtcactgacatgaagaccattcacaagttgacataa

SEQ ID NO: 4063 - DNA, 351 bp, Glycine Max
atggcactgagggcagccgtactccgccacgttcgtgtgccactccaagccgctccgaaactgcagccatggcgtgccatgtcatcacacggcgacgatcatctctccaaagaggaggtcgtcgaaagagtcctcgctgtcgtcaaagatttccccaaagtcgatccttccagggtgagtccagatgtacatttccagaaggatttgggtttggatagcttggacaatgtggaaattgtaatggcactagaagaggagttcaagctagagatcccagacaaggaagctgataaaattgactcttgtcatcttgctattgagtatatttctaaccatccaatggctggttaa

SEQ ID NO: 4064 - DNA, 1785 bp, Glycine Max
atggcactgtcgtgtctcacactcactgccaacccttcttccatcatctgcaaattcaaagcgtccctacctaccgctccccacgccctcgacgccacctacatccgacgcgccgcccacctcgccgacaaatccgccggcttcacatccccccaccccaacttcggctgcgtcatcgtctccccctccggcaaagtcgccggcgagggctacctctacgcccagggcaccgccgccgcggaggtccaggccgtcaaggccgccggcgaactctgccgcggcgccaccgcgtacctcaacatggagcccggcgactgccacggtgaccacagcgccgtctctgctctgctccagggaggggtcaaaagggttgtggttggaatgaggcatcccctgcaacatctccgtggcaatgctgtccgtgcactcagaaaccaagggctgcatgttgatcttcttggagaggatctcactagtaatctcattgaggatgcgcagaaagagtgtcttcttgtcaatgcacctttgatttgtagagctgctttgcgtgttcccttttccgttcttaagtatgctatgacccttgatggaaaaattgctgctaccactggccatgcatcatggataagctgcaaacagtctagaaatctagtttttgagttacgaggtagaagtgatgctgttattgtgggaggaaatacagttcgaagggacaatccaagactaacggctagacatggaggggggcatatgccaatgcgcattgtaatgacccagactcttgatcttccggagaaagcaaacctgtgggatatgtctgaggtttctaccatagttgtaacacaaaggggtgcaagaaggagtttccagaagctgcttgcatcaaaaggagttgaggttgtggagtttgacatattgaatgcccgagaagttatggagtatttccatgatcgtggttatctttcaattttatgggaatgcggaggaacattggctgcatctgctatttcatctggagtaattcacaaggtttatgcttttgttgctcctaaaattattggtggaaagaatgcaccttctcctgtgggtgatcttgggatggttgagatgtcacaggctttaaatctaattgatgtttgctatgagcaggttgggcctgacatgcttattagtggatttcttcagcccttaccagacatggtacctgtaatcccatcacccgatgaaacttttgttgctgatcctactgtctcaccatatgattcaaggatcatatttttctataaaacatgggatccttatggtgcattttcaaatttctctcctcatcccattcaaatgcctgatgaaaatggtgattatgtgacttggatgagtgtcgagcattactaccaggctcacaagtttattggggtggatgatcctttggcacaagattgtgttgaaatgattaaatctgcaaaaagtccagaagaagctgcaagaataggaaggtcaatgcaaaagcagaaaccctatctgataaggtctgactgggacaacataaagatcgatgtcatgtacagggcactgaaatgcaagttctcaatctacccacacttgaattctatgctgctctctactgctggttctgttctagttgaggcttcgccacatgatctgttttggggtggaggccgagacggtgaaggcttaaattatcttggtaggctgttgatgaaattgagatcagagtttcttggggagtcttcatcatcaagtgagacccctagtttaactgtatag

SEQ ID NO: 4065 - DNA, 618 bp, Glycine Max
atggcagagcttgagagtcctaatgttatgcctaagcttatatcatttctctcatctctcctcaaaagggtagctgaatctaatgatcttaaccagcaacaactcctacaccaaaaggtctcagttttccatggcttgactcgccccaccatctcaattcaaagctaccttgagagaattttcaagtatgccaactgcagtccatcatgcttcattgttgcatacgtctaccttgatcgcttcactcaaaggcaaccctccttgcccatcaacttctttaatgtgcaccggttactcatcaccagcgttatggtggctgcaaaattcatggatgacttgtactacaacaatgcttactatgcaaaagttggaggaattaccacaatagagatgaactttcttgaggtggactttttatttggtttgggtttccatttaaatgtaacccctggcaccttccaagcgtactgtgcacatctccaaagcgaaatgctgctgatgcaaccactgaattttgcagattcttccttaagtttaggaaaatctctaaaggcacatttatgctacaatgaggacgaatcttcttcccatcaaaagcaacaacaattagctgtttga

SEQ ID NO: 4066 - DNA, 645 bp, Glycine Max
atggcagctgcttctcctatggcaagccaactcaagtccaccttcactaaaactcttgtagctcccaagggcctctctgcctcttcaccactccacctcctgccttctaagaggcaatttagcttcactgttagggccatccaatcagaaaagccaacctatcaagtgattcaaccaatcaacggtgatcccttcattggaagccttgaaaccccagttacatccagccccttgattgcatggtacttatcgaacctccccgcatacaggaccgcagtgagcccactactaagagggatcgaggtgggcctggcccatggctaccttctggtgggcccattcgtgaaggccgggcctctgaggaacaccgagatcgccgggcaagcgggctctctcgccgctggtgggcttgtggtgatcctcagcctttgcctcacaatctatgggatttcatcttttaacgaaggagacccatccactgccccgtcactgaccttgacgggccgcaagaaggagcccgatcagctccaaactgctgatgggtgggccaagttcaccggaggcttcttcttcggaggcatttcgggtgttatttgggcctacttcctcctctacgtcttggaccttccatactacatcaagtga

SEQ ID NO: 4067 - DNA, 174 bp, Glycine Max
atggcagttcatgggatggatggactgagtattttacaatggacaatggagttattaggatttggtttattactccgtgtctttaacatttctccaagaagctttttagtattgtggattgtaagtggtaaagatcctgaaattatgatgctcttagctgatataaaattgtaa

SEQ ID NO: 4068 - DNA, 789 bp, Glycine Max
atggcatcctcgttggcaccagctaccaaagccgccactaatttgcgcctcacacactctctccgcttctctcctaaacccaacaacctacgctttgccaccaagcctggtaatacgctgttatgcacgagggttaaggcccaattaaatgaggttgcccttgatagttcctccaatgctacttctcctcctatgaaagccaaatcaaaggaggaaccacccgcaaagcctttagcagaaccatcttcttcagtgttggcaactcaagaatcggtctctcagtttattactcaagttgcaagtcttgtcaagcttgttgattcaagagacattgtggagttgaagctgaagcagcatgacgttgaagtaacaatcaggaaaaaggaggctatgcctcagccaccacctgctcctcaaccttctgtggtgtattcaccccctccaccagcgttgccaccaccacctgtaccagcatctactccagcacctactctagctcgtgcaacccctacaccaacttcagcccctgctgtgaagtcagctaaatcatcacttccgcctcttaaaagccccatggcagggacattctaccgaagtcctgcacctggtgaaccttcctttgtgaaggttggagacaaagtaaagaaggggcaagttgtatgcatcattgaggcaatgaaattgatgaatgaaattgaagctgatcagtcaggaactatagttgaaatcgttgcggaagatgccaagtctgtaagcgttgacactcccctatttgtgattcaaccatag

SEQ ID NO: 4069 - DNA, 2490 bp, Glycine Max
atggcatcgccgaccgaggttatcgacgtcgacgccgaaaacgctcctactcctactccacctcctcctcttccaccgcaagatccgaaatcgaatcgcgccaagaccatcatgcggaagcggaagaaggttccctcgttgctgcaaaacctaaagagctacgaggagaagcaagcgcacatcgaaaccctcgagaaggagctcgacgcgctgttccgctactaccaagaagccatggctcagaaagtgcgtgtcgagctgagccagtgcggtggttcgcgaaatgttgtcgtcgcggcgctgatggaggagagcgaccttccactgtcgaagctcgtggacgagattcacgacaagttgaacgaagaagtaagtaacggcgcaatcgtgctggcggagcctgtgacctacgcgacggtgaagagtagcgcgttgtttgtgggacagagagtgtcgtacggcgtgccaaacgctgatgctgatgtattggaggaccatgccgagtcgtgtctctggtgttgggagactagggatttgaaattgatgccaaaatccgttcgaggagagctcagtgttcgacgcacttgccggagaaggatccatgagaggattatggctatctctgaaatgatagcagctctgaaaaagctagagagtgaacctgattacaatcaaggcttaattaaggcatcggcaaagctcaataaagcttttcccgaagcagatatccgcttgttagtggatggcttgttgcagaagaacagtgaagacatggacaagaaaagaacaagccaagaaaataaattgctaattaagcagttggagagaaatagaaaagaagctgaaaaagagaaagagaaagaaagcatgcacaatgaactgcaaagagaaacactgctcaatgtaagggctgctgttttgatcctgcaagaaatgataaagaaacaggtagatgaggcagaaaaggatcaacggcgtagagagaaagcagaagctgaattaaaaaagaagcggagtttacaaaagcaagcctcaattatggagcgttttctgaaaagaagtaaaattattccctcatctccatcatctgagaaggacatagtttcaactaaatcaactgcatctgatttgccaagcagcaagagtgaaagtttgtttgagtcagctacactttcaatggattgtactcttgcatcaagcagggatgttatgcttgaagatattcgcaagcaattttgttttcagatcttactaaaaataaaacagagatggggcttacgccagaaacctcggactgaagtttttaaggaacttaagctgagtgccattaaaactgctgttcaagatgttgagttggacacggagaaacatgttgacagattgggagaatgcagttctgatatcagttcatgcccaatgaatgcagatagttctcctgatgccaagtacagtcggggtagacaattattgcagtttgataaatctcatagacctgccttttatggtgtttggcctgcaaaaagtcatgttgttggaccacgccatcctttaaggaaggatccaagcctggattatgatgtcagcagcgatgaggaatgggaagaggaggaacctggtgaaagtctttctgattgtgataaagatgaagaggaatgtcaagaggaatgtacaaagtctgatgaagaaagtgaagatgggttctttgtaccagatggatatctttctgaggatgagggtgcacaagtggacagaatggaaatagatgatgacattgacggggctgatagctcccctagctgtaagaatgacatagagagcgaggaattttgtgctttacttcggcagcagaaatatctaaataatttgacagagcatgctctccggaaaaatcaacccttgattatatcaaatttgattaatgacaaggacctttcatctgatcacaatattagtggtactcctaagctggagcagatgtgcttgcaagccttgagtatgtatgtaattcctggcatctcatgtatagaaatatatgtggataaaatgcaagacgaggaccaagaagtctgcctctctactggtaaaagtggtgctagtccaatatctggtgtagctgtcatacctgactcagacctacccataattgtgactactattcaaagttgttctcaaggtatgaataaagtgttagtgtctttgcaacagaagttcccttctgtatctaagtccttattgaagaataaagtgcgtgaagtatctgactatgttgataaccgcttgcaggtgaagaaagaagttctggataagcttggctcggcagttaaacctggaaaaagcagtgggggaccaaggagcattgctgcatttttttcaaaaaggtgcttgcccccgactggggaaggttcgaaacctggtgaaacttcaccactgccacccctgaaatcatcttctgccattgatgaacgacctcaaagttcatataacatataa

SEQ ID NO: 4070 - DNA, 1050 bp, Glycine Max
atggcattgggaagagtaatatacgttgctcacaccgtatgtatcagatcagagcttcaacccatggcacctgaccgcattggttcttcctcttcttctcgccaaagggacctcgttttcgtcgtcaaccctctaggtgctaatgggaggacaggtaaagaatggaggaagttagttccatatctacggtctcgtcttggtaaagagtgcaagatatgtgaatccataacgtcgggtccttgtcatgctattgacataacaagagaggctataagggagggggctgatgctgtcattgctgttggaggagatggaactcttcatgaggttgttaatgggtttttctgggctggaaaacctgttgttagtcaagtgaaagagtctacacactcaactgctcttgggctcatccccttgggaactggttctgattttgcaagaacatttgggtggaaaaatgatccccatgaggccattgaacgtgttgctagagggttgagatcaatgatagatgtcggtgttatcactggagagagttgcgaccatcattacttcataaatgtcgccgacattcattggagtgcaaaggcgggtttttatgcttctagatacaagagatttggcaacctgtgctatgtcattggtgcattgcaagccttcattgggcatcaaaaccaggacatgagaatcaggttcaatgatggtccatgggagacatgtcctcaagtgacagccctttgcattggaaatgcaaaatactttggtggtggcatgaaaattacaccaaatgctgatcctttcagtagaaatttagaggttgtaactcttcagaacttcaagtggtatgattttgtcttgaaattacataagctatacagtgggacacatctctcagtaaaaaatgtatctgatagaagtgtactttctattgaggtggaggacatatcaggcatgggtggtggtatttatattcaatctgatggggagcatttggggttccttccaaaaaagattagtgttgtgcctgctgctattgagatgatattgtga

SEQ ID NO: 4071 - DNA, 1521 bp, Glycine Max
atggccatggaaaatcaaaattttctagagtattgggttttgccactacttatgatgcttttgttgggtcattggatctctgttcaagctgccccttcaccctctctcatcactcaactccctggctttaacgccaatttcccatccaagcactattccgggtatataagtattgatggaaatgctgaaagtgggaagaacctgttctactactttgttagttcagaaagtagtccagagaaggacccagttgtgctatggctgaatggtggacctgggtgctccagctttgatggctttgtttacgagcatggaccattcaactttgaggctgcaaattcaaaagggaatctacccactttgcatatcaatccttacagctggtctaaggtttccaacattatatatttggactcccctgctggtgttgggctctcttactccaagaacacaagcaaatatgccactggggatctagaaactgcgtctgatacccatgttttcctcttaaaggggtttcagcaatttccggaattccaggctaatccattttatattgctggagagtcttatgccggagtttatgtgcctactcttgcttttgaagtcgctaaaggaatccggagtggtacaaagcccgtgatcaattttaagggttacatggttggaaatggtgtcacggacgaaatatttgacggcaatgctcttatcccatttgtgcacgggatgggcctcatatccgacagtatctatgaggatttacaatcttcttgcaaaggaaactactacgatgcttactctttggacgaaaatgatgtgtgttacaagaccattgaaaaagttgatagggccattgatggccttaacgtgtacaacatactagagccatgctaccatttccccgatgctgccacagccaaagaaaatggaaccttaccaaggagtttcaagcaattaggagttactgagaggcctctcccagtgagaaagagaatgtttggtagagcttggccttttagagcaccagtcaaacctggtcttgttccattatggccccaattggctcaaactaggcacgtcgcatgtgttggtgatgaagtagcaagttcatggctaaacaacgttgcagtcaggaaagccatccatgctgaatcggaaaaagtggcgggtccgtgggaattatgttcgagtaggatagagtaccatcacaatgctggaagcatgattccttaccacaagaacctaaccaggcttggctatagggcacttattttcaggggcgaccatgatatgtgtgtaccgtttactggaagtgaggcttggacacgatctttgggttacaagattgtggatgaatggaggccatggaactcaaataaccaagttgctgggtacttgcaagcgtacgagaacaacctcaccttcctcacaatcaagggagctgggcacaccgtgccggaatataagccgcgggaggcgttggatttttacagccgttggttggaagggaagctaatataa

SEQ ID NO: 4072 - DNA, 969 bp, Glycine Max
atggccattgctatgaaggccacgcctatcacggcttcgggcttcgtttcaacaagaaattccacacttccaccctttaaatcatcatttctcagataccgcgcaggagcattggaagttcctggcatgcgggtaacctactcagatagattgaaatgtaattgtcatggtggcggtgcccttggcactcaaatgaatctttttagcagatttgctagagttatcaagtcatatgctaatgccattataagctcctttgaagaccctgagaagatattagaacaagctgtgctggatatgaacaatgatttgatcaaggttcgccaagctacagcacaggttctagcatctcaaaagcagttagaaagcaagtacaaatccatagaaaaagcttctgatgattggtatcgaagggcgcaacttgctcttcagaagggagacgaggaacttgcccgtgaggcacttaagagaagaaagtcttatgcggataatgcaactgctttgaagatgcagcttgatcagcaaaagaatgttgctgatgatcttgtgtccaaaacacagcttttggagagcaagatacaggaggcaaagtcaaagaaagataccctcaaagcaagagctcagtctgcaaggacttcaaccatagttagtgagatggtgggcaatatcaacacaagcagtgcccttgcagcttttgataagatggaggaaaaggtattaaccatggaggctcaggcagatgctttgaatcagttgagtactgacaatcttgagggaaagtttgcactactggagaactcttctgtcgatgatgatcttgcagagttaaagaaagaattatctggaagctctaagcggggagaacttccacctggaagaagtgttccaaccagtaaagaaattcccttccttgacttggagcttgagaaggagcttaatgagctcagaagaagagcaaaggggtactag

SEQ ID NO: 4073 - DNA, 1990 bp, Glycine Max
atggcccatgcccagaagctgtttgatgaaattccccagagaaacactcagacatggaccatccttatatcgggttttgcccgagcgggctcttcagaaatggtctttaaccttttcagagaaatgcaggcaaagggtgcttgtccaaatcaatataccttgtccagtgtcttaaagtgttgttcacttgacaacaatcttcaattgggcaagggagtccacgcgtggatgctcagaaatgggattgatgtagatgttgtgctggggaactctattcttgatctttacttgaaatgcaaggtttttgagtacgcagaaaggttgtttgagttgatgaatgagggggatgttgtgtcgtggaatatcatgatcggtgcgtatctgcgtgcaggagatgtggagaagtctcttgacatgttcaggagattgccttacaaagatgtcgtaagttggaatacgatcgtagatggattgctgcaatgtggttatgaaagacatgcattagaacaactctattgtatggtggaatgtgggactgagttctctgcagtcactttctccatagctcttatcttggcttcctctttatcacatgtggagcttgggagacaacttcatgggatggtcttaaaatttggctttgatagtgatggctttataaggagttcacttgtagaaatgtattgtaagtgtgggagaatggataaggcgtctataattctcagagatgttcctctggatgtcctgagaaaagggaatgctcgagtttcttataaggaaccaaaggcaggaattgtttcatggggttcaatggtttctggctatgtttggaatgggaagtatgaagatggtttgaaaactttcaggttaatggttcgtgaactggttgtagtggatattcgaactgttacaaccattatttctgcttgtgctaatgctggaattttggaatttggaaggcatgttcatgcttacgttcagaaaattgggcatagaatagatgcttatgttggttcttccttaattgatatgtattctaaatctggtagcctggatgatgcatggatggttttcagacaaagcaatgaacccaacattgtcatgtggacttcaatgatatctggctatgcgctacatggtcaaggaatgcatgcgattggtctttttgaagaaatgttgaatcagggtattataccaaatgaggttacttttctaggggttttaaatgcatgcagccatgcagggctgattgaagaaggctgtagatattttaggatgatgaaagatgcttattgcatcaaccccggagttgaacactgtacttctatggttgatctttatggtcgagcgggtcacttaactaagacaaaaaacttcattttcaaaaatggtatctctcacttgacttctgtgtggaaatcatttttatcatcttgtcgacttcataaaaatgttgaaatgggaaagtgggtttctgaaatgctacttcaagttgcaccatctgatccaggagcatacgttttgctatcaaatatgtgtgcttctaaccatagatgggatgaggctgccagggtaaggagtttaatgcatcaaagaggggtgaagaagcagcctgggcaatcttggattcaactaaaggatcaaatccatactttcgtcatgggagataggtctcatcctcaagacgatgagatatattcatatctggacattttaattggaaggttaaaggaaattggatattcctttgatgtgaaacttgtcatgcaggatgtagaagaagaacaaggggaagtacttattagtcatcacagtgaaaaacttgcagttgtctttggcatcattaacactgccaataggaccccaattcgaattataaagaacctccgcatttgtacagattgccataacttcattaagtatgcttctcagcttctagatcgtgaaataattgtaagagatattcataggttccatcattttaagcatg

SEQ ID NO: 4074 - DNA, 1326 bp, Glycine Max
atggccgcttcagcccattcttctcttaagaagatgtcatgggctaagggtcaatcctctggttggacagcttttgatctcaagcagagaaagaataaggattttgaatctgaagttgacgacgaccctttcccagctataggccctactgatcctataatcaagaagaatcatgttcccgcaaagcctttctcttcagtacttctcccaactaaaaatttccccccattgaatgaggatgggaatagcaaaaaggcaatgctaggttctgattctgatggaaaatattgtggggctactactcaggaagatgttaatttagctatcaaaaagcttagagagcagcatctttgggctgaacatagcttgatagacgatatcttcactgctgttaataacaatatcgacaaggccacatctttattggaaacaatggcccctgcagtgaattttgaagaatccaaaaaaaggttgaggatgacattcccttcgattataatcttatgcaaaatgaaactcttgaattctgttcctgttgagcctgaatgggaggatgatgatatttacattagcaatcgaaaggatgcattgaggacaatgaggttagcatcacgccattctaaggcagcttctagtgcttttctaagaggtgatcatttttctgctcaacatcattcaatgaaagctcgggcggaatggcatactgctgaagaacttaattctgatgcagccaaaaaaattttaagtatcaggaataatgaaaatgatatctggagacttgatttgcatgccacttcaaatggagtgaaggaaaatgggcttggacattctactcttggatctttcaatttcatggacagggaaaaattggatacacaagcaccattacggcttagaccttgtcattttactgaagcaaacattcttcaaaatcatactaacccttccgtgaaaacactaatcatcctgttttgcatgcaactggtgtggcacatgggttccttaaccacgttttgtggttcgatccccggcttgggcatgaaattgcacttgggagttaccactttatcccaaaatgggccgatccgatggaaggataattattgtttctttgggaaaattatagaaaaggaatattatatccaaagaacttctcctttgcacagccctaattacattttcatttctacaggcatcggtaatcacagtcgaggactggcggctcttcctgcagctgtcagaagtttcctcaatgaaaacaggtaccgttttgaggagatgagaccaggagtaattacagtgtggcccaagtttcgtcaaaactga

SEQ ID NO: 4075 - DNA, 807 bp, Glycine Max
atggccggcatagacttgggttcagcatcacattttgttcatcatcgccttgaacgccctgaccttgaagacgatgagaaccaacaagaccaagacaacaaccttaacaatcacgaagggcttgacctagttacaccaaattcaggtcctggtgatgttgttggtcgcaggccaagaggaagacctccaggttcaaagaacaagccaaaaccaccagttatcatcacaagagagagtgcaaacacccttagggctcacatccttgaagttagtagtggttgtgatgtctttgaatcagtcgctacctatgcaaggaagcgacaaagagggatctgtgtccttagtgggagtggaaccgtgaccaacgtgacgttgagacagccagctgcagcaggtgccgtcgtcacgctgcacggaaggtttgagatcctgtctttgtcaggatcgttcctcccacctcccgctccaccaggtgctacaagtttgaccgtgttccttggtggaggacagggtcaagtggtgggaggaaatgttgttggtcctttggtggcttctgggcctgttattgttattgcttcatcttttactaatgtagcatatgagaggttgcccttggatgaagaggaatctatgcagatgcaacaagggcaatcatctgctggcggtggtggtagtggtggtggagtcagtaataactcttttccggacccgtcttctgggcttccattcttcaatttgccccttaacatgcctcagttacctgttgatggttgggctgggaactctggtggaaggcaatcttactga

SEQ ID NO: 4076 - DNA, 501 bp, Glycine Max
atggcctttgtcaccactgctgaagtgtgtgatgcgaacccacagttaattttgagtggggagcttcgtgcccttcagccagtttttcagatttatggccgtcgacaggttttctctggacctatagttaccttgaaggtgtttgaagacaatgttttggttcgtgagttccttgaagagaaaggcaatggaagagttctagttgttgatggaggcgcgagtttacgctgcgctatattgggtggcaaccctgtggtacaagctcaaaacaatggatgggcaggtattattgtgaatggatgtataagagatgtggatgagatcaatggttgtgatattggagtgagagcccttgcttcccatcccatgaaagccaataagaaaggcatgggagagaagcaggtccccataaatattgctgggacaaggatcagtgatggggaatggctctatgcagacactgatggaattctgatctctcgaacagagctgtctgtttga

SEQ ID NO: 4077 - DNA, 1056 bp, Glycine Max
atggcggaagattgggatctacatgcggtggttagaggctgctccaccgttacatcatcctcagtgtcttcttcttcatctccttcttcctctggttttgcctcttcttacttccaccctgaagctgcagtttcttcttcttcttcttcctattctggcttcaacatcttcaagggtgaacaaggaataagccaagttttgtcgctctctgcgtacccctttgaggcaaggagctccattgaggaattgcatgagctttgcaaacctttcttctccaaatctcagcctctaacgttgcaagcctcttcacctttgtcctcactctcttcctattcctctgcgccacccaaatctgtttcaacgcaagagaaacaacaacagaggagcaagcaggcacatgctgtcaccaccccacgatctaaaagaagaaagaaccagcttaagaaagtttgtcaagtgccagttgagaatctctcctcagacatatgggcatggaggaaatatggccagaaacccataaaggggtctccatatccaagggggtactatagatgtagcagctcaaaggggtgtttggcaaggaaacaggttgaaagaaacagatcagacccaacaatgtttatagtgacttacactgctgagcacaaccaccctgctcctactcacagaaactctcttgctggctccacacgtcagaagccattggtacctcaaacagccaccaccactgaagaagactctgacaagagcaagagcctcacaaaacccacttcccctgccacctcaggggcagaagaagaggctccaacaccatcacaaggggaaaagtctgagagcagagaagagaaagaggatgtgatggatgatgaggaagaagatgaatttggcttgtctgatatggtgctttcagatgacttctttgaaagtttggatgaactgagccaacttacggctccttctgttgtcactggagactgtttcagtgaccccttttcagcaattgcaatcccttcttgggtggctagtggtgctgctactgctagtgggtgtagatga

SEQ ID NO: 4078 - DNA, 708 bp, Glycine Max
atggcggataagtttggcaatgctgaaaggaaagacagggagatgggtcatctctatgctttggactttgatggagttatctgtgatagctgtggtgagacagctatctctgctcttaaggctgccaaattgagatggcctcccttgtttgatggtgtggattcaaccatagaagattggattgttgaccagatgattacggtacggccagtggtggaaactggatatgaaactcttttacttgtgaggttgttgcttgagactagagttccatccatcaggaagtcttcggtttcggaggggctcaaagttgaggatatactggagaactggttcaaattgaagcctatcattatggaagaatggaatgagaatagagaagaactaatagacctttttgggaaggtcagagatgactggttggagagggatttcacaggttggattggagcaaacagactctatcctggtactgctgatgctttaagatttgcaagctcaaaagtgtacattgtcaccacaaaacagagccgctttgctgatgctttactaagagagcttgctggagtgactatagcaccagaaagattatatggtctaggaacaggtcccaaggtggaagtgctaaagaagcttcagaaaatgccagaacaccaggggctgacactacagttaagatattgtgctttcagaggttattttatttga

SEQ ID NO: 4079 - DNA, 387 bp, Glycine Max
atggcggcgagtagaagcacttttcctctgatgaaatacttgagagtgcgcgtcgacgctcttccccgcaacactcccttaaccctcgctcccaactttttgattcgccgcttctgtgaagaggttaggggttgttttctcgacaagtctgaggtcacagatcgcgtcatttcctgcgtcaaaaacttccagaaagttgatccttcaaaggttaaccctaatgctcacttccagaatgaccttggattggatagtttagattcggtagagattgtgatggctcttgaggaggagtttgggttcgagattcctgataatgaggcagacaagatcaactccattaaacttgcagtggacttcattgcatctcatcctcaggcaaagtag

SEQ ID NO: 4080 - DNA, 1278 bp, Glycine Max
atggcgtcggtgttcgtgtaccacgtggtgggcgatctgacggtggggaagccggagctggcggagtttcacgagagtgagacggtggagtctgcgattagggcgattggggagtcccctgaagggagcatacccatttggaagaagagatctcaattggggattgagaacagtgacatgagacagcagaggtttgttggtattcttagttcctttgacatagttgcgtttttggctaagagtcggtgtctggaggatcaggacaaggccttgaagactcctgtttccgaggttgttgttcataacaattcgctgctcagggttgttgaccctgcaacaaggttgatagatgcgctggacatgatgaaacaaggtgtgaagcgtctgcttgttccaaagagcatagcatggaagggcatgagcaagcgattctcagttatctactacggcaagtggctcaagaatagtgaatctcctggcaacagcagcaacaatctaccacttagcatgaatcggagcccctcaacttccgttactcctatccctgataagtactgttgtctctctagagaagatgtgctccgtttcatcatcggttgtcttggcgcattggctccccttcctctcacttccattgctgctcttgaagcaattaattcaaactacaactatattgaatcttctactccagccattgaagccactcaaaagcttcctcaagatccaagtgctgttgctgtaattgaaagcgcatcagatggtcagtgcaagatcattggagaaatttctgcatgtaagttatggaaatgtgattacttatccgcagcatgggctttagcgaatctctccgcaggacagtttgttatgggagttgaagataatgtcaccccaaggtcactgcctgagtttagtttagattcaccatctggagacattgatttagttaatagtgggggttcaaggaaaccaaggaaatttagtagcaggagtgtcgggttcttcagcaattctgcgagccataactttagttctagaagcatgtataggggtaggagtgcacccctgacatgtaaaattactagttcattggctgcagtattggctcagatgctatctcacagggcaactcatgtctgggtgaccgaggacgagaacgatgaagttttggtcggtgtggtcggatatgctgatattttagctgctgtaaccaaaccacctacaaccttcattcctgctaatagatctacagaggggtttggaaatgaaattcagtgttga

SEQ ID NO: 4081 - DNA, 1854 bp, Glycine Max
atggcgtcgtgccccgcgaattccttcaacttcaacaccaccctctgcgcgtgcacccccggtcacgtgctacagcacgtgaggaacacgtgcgtgctctacgaggggaattccacaatcctcaccgattctggcgttgactactacgcgctgagcttccccgagacgctcttcgcgttcgacaccatcaagaagttcacgcagtcgcaggcggtgttcttggaagtcacgctcgtgatgcttctctcgtggcttctgttctgcgtgtttctgaggtgcacgaagctgggtgatgggaggaatgtttggttcaagatcaggtggtggatcagtaggttggatatttgctttgccacaaggcactggctggatgatcagaaagtggtcactaaacgcaaaacagaacttggtggagctttctccatggcaagttggatactatttattggtttatttgccgggttgctgtaccagatcatatcaaagagatcaattgaggtgcacaatgtcagagcaacaaatggaccggagttagcctcttttatcaatgacatggagttcaatataacaactgtatctagtatgagctgtgcaaatctacgtaatctgggtaatatagttacggggaatcctggcttcattgaccaaagagttgttcctctctcgactttagcaaactactcttgttacaactcaagcatgggaccaactatagcactcaagtgtaaaaactgcaaggtcatctatgatcacatgtacatttcatggcagtttgttgatctccccaatagtcctgccattgctgttggttttgagtttagactcacttcaatggatattgctaagaaacatgtgagtttcgttagtggaacactaaagaatgggagtgattttgatgatagcccggttacattcagagggaatcaatcgaatattgtgaaattcaatttgttccctcgaatatatcataatttacatgagctaaagctcatacagcctttatttcacgagttcatcccaggttcagttttgcgtgatactaatgagcttcgagcatcccttgaaagttctactgatggactagtcaacactacattgtttatcaattttctctctgattatgttgtggaaattgataaacagaatattttgggtcctgtgagcttccttgcggaccttggtggcttgtattgtattagcataggcatctttttctacctgttgatacagtgcgagtataggataaagaagctcagaaatgaagatagcattatgcgcagaattagaaatcggcgtaaagctcaagaacattgggacaaactgaggaaatatgtaatgtacacctacggctgtcctacaatagacaacaactacaatagcactggaaaggaaacagattgtggtggatgtatgttgcattcagttcgtggtagtggttcatcacgtaaacgaaggctgaaaagcagaaaagattctataagtttgtaccagaaacctagcttacctgataacaagtcagcgagctgcaggccgcttggatccacaaatgattccaaattgaattctgagaatatggcaaagcagcagaatgctgtttcatgcttggattcccctcagtctcagcctcaagaatcttctattattgatgataaattcattcctcctccaccttcactagaaattaagggtggctctgaaatggacttgtccgatattcagaagaatctaaaaaatttgtacgagtataatgtcatgctaagggacaaattattagctgcacaatcactgctcaattcttcctcaactaggcacacttcttcagtaaactcttcagtaaataacaaggaaacttag

SEQ ID NO: 4082 - DNA, 1176 bp, Glycine Max
atggcgtttccctacatggaagccgttgtcgggtttatgatattaatgtacatatttgaaacttacttggatgtgcggcaacatagtgccctcaaacttcctactcttccaaagactttagaaggagttatcagccaagagaaatttgagaaatctagagcctatagtcttgataaaagccacttccattttgttcacgagtttgtgacaatagtgatagactctacaattttgtacttcggagtattgccctggttttggaagatatcaggagattttatgacaatagccagtctcaatgctgagaatgaaatactgcatacccttgcctttttagctggggtgatgatttggtcacaggtaactgatttgcccttttctctgtactcaacttttgtgattgaggcccgtcatggttttaacaaggaaggaggtccatacttggccatctatctttgggcttttacatttggtctttctattgtgatgatgaccctttatccagtactaatagctccactcttcaataagtttactccagttccagatggtcaactcagggagaaaattgagaaacttgcttcctccctcaactatccgttaaagaaactatttgttgtcgatggatccacaagatcaagtcacagcaatgcctatatgtatggattcttcaagaacaagaggattgtgctttatgacacattaattcaacagggcaaagacgatgaggagattgttgctgttattgcccatgagttgggacactggaagctcaaccatactgtgtacacgtttgttgctatgcaggttcttacacttctacaatttggaggatatacactggtgcgaaattcaactgatctgtatcgaagctttgggtttgatacccagccagtcctcattgggctcatcatatttcaggatactgtaatcccacttcagcaattggtcagctttggtctgaaccttgtcagccgatcatttgaatttcaggctgatggctttgctaagaagcttggatatgcatctggactacgcggtggtcttgtgaaactacaggaggagaatctttcagctatgaatacagatccttggtactctgcttatcactattctcatcctccccttgttgaaagattggccgcgctggacgaaccggataagaaagaagactaa

SEQ ID NO: 4083 - DNA, 606 bp, Glycine Max
atggctactcttcctcttctccgaccatgctgcttccttcccactcccaccctcaaaccctcactcacaagacccacacccttcttacctctcaaatcgaagaagaaccctcaaaacggcgccgttgggactcgcatgtcgaacaccgcaactccaccaccgacggagcggctaatctcaatcgcatcctacgcactcccattcttcaactccctccagtacggccgctacctcctggcgcagaaccctaccctcgccgtcctcttcgaccccatcgtgcccctcctcgccttctacagatccatcccttactcctccttcgtcgccttcttcgcgctctacttggggatcgtcagaaaccctagtttcccccgctacgtcaggttcaacgccatgcaggccgtcaccctggacgtcctcctcgtcctccccctcctcttccaccgcatcttctcccccgcccgcggcggccccatcctcgtctggtccagcaacgccattttcatcttcagcctcatctgcttcgtttacagtgttgcttcttgcgtcttgggacgcacgccgcacttgccttttgtcgccgacgctgcttctaggcaaatttga

SEQ ID NO: 4084 - DNA, 870 bp, Glycine Max
atggctctgagcttcaacaatcgaagaatccctctcgctcttcgcattttccttctgttctccttattcttcagcctctcaccgaccttcgctcaggattctctcgttcagaacgcgaaggaagattccggcggatctgtggatctcggtcgccgcgccaagattgcattgaatgacatagagaatgattcgatcctttctcttggcttggactccactggtcctggactcttcgacgcatttttcgcgagtttttcgatgatccttgtcagtgagattggggatgagacgtttataatagcagctcttatggctatgcgtcaccctaagtcaattgtcttgtctggtgctctcagtgctctgattataatgacagtactttctacagggcttggcaggattgtgccaaatttgatttctaggaagcatacgaatagtgctgctacagttctttatgctttctttgggttaaggttactgtacattgcatggagatcatcagattcaaaatcctcacagaagaaagaaatggaagaagttgaagaaaaactggatggtggacaagggaaaacttcagttcggcgcttcttttcaagattctgtacaccaatatttttggagtcttttattttaacattccttgctgagtggggtgatcgtagccagatagcgacaattgcactggcgacccacaaaaatgcaattggagtagcagttggggccactataggacacaccatctgtacctctctggctgtggtgggaggaagcatgctggcatctaagatttcccaacgctcagtagccactgttggtggcttgctcttcatcggcttttccatatcttcatacttctatccgcctctatga

SEQ ID NO: 4085 - DNA, 1122 bp, Glycine Max
atggctcttgagtctgctcctgcttcagctgacatcagaggagttcacactcatggtggacgctatgttcagtacaatatctatggaaacctctttgaggtctctaggaagtatgttcctcctattcgccctgtgggaagaggagcatatggtattgtttgggctgctgtaaatgcagagacacgtgaagaagttgccattaagaaggttggcaatgcatttgacaacagaatagatgccaaaaggactctacgagaaattaaacttcttcggcacatggatcatgaaaatgtgatagcccttaaagacattatacgaccaccacagagggataacttcaatgatgtgtacattgtttatgagttaatggatactgatctgcatcaaataattcgatccaatcaacaattgactgatgatcattgtcgggattttctttatcagttgctacgaggactcaaatatgtacactcagcaaatgttctgcaccgtgatctaaagcctagcaacttgctactgaatgccaactgtgatcttaagattgcagactttggtctcgctagaactacatctgagactgatttcatgactgagtatgtggttactcggtggtaccgagctccagagttacttcttaattgctcagaatatactgctgccatcgatatatggtctgtgggttgcatccttggtgaaatcataacaagacaacccctatttccggggaaagattatgttcatcagctcaggctgattacagaggtcataggctcacctgatgaccatagccttggatttctacgaagtgataatgctcgtagatatgtgagacagcttccacaatatccaaggcaacaatttgctactagattcccaagtatgtctcctggtgctgttgatttgttagagaagatgcttgtctttgatccaaataggcgcattacaggtaaagaagctctgtgtcacccatacttggcacctcttcatgatattaatgaggaacctgtttgcgttagacctttcagttttgattttgagcaaccatctttcactgaagaagatatcaaggaactcatctggagagaatctgtgttattcaatcctgatccacctatttattga

SEQ ID NO: 4086 - DNA, 378 bp, Glycine Max
atggctggtcgattccgtgagctgatgaagaaatatggaaaagtcgcactcggcgttcacttgagcgtctccaccgcctccatcacgggtctctacgtggccatcagaaacaacgttgacgtggaatccatcctcgagaagttccacatgggcaccgtctccgagggacaaaaccctaaccctaatcactcagacggcgccgccgcgccacccaagaaccggacggctcagatcgccgcctccgccggcggcgccttcacgctggcgatcctctgcaacaaggcgctgttccccgtgcgcgttcccataaccgtcgccctcactccccccatcgcgaggttcctcgcgaggaggaagatcatcaagagcggcgtatga

SEQ ID NO: 4087 - DNA, 2733 bp, Glycine Max
atggctgtggtgagtcctatgcctgcaacaacacaaaggatgggttcagtgaggtcactttctgatgctggtggaaaatttttggaagagcctaatccaagtgtggttgatcagccaatctatgttgctgtgacaaaagaggtgaaggagagcagattaaatctgatatgggcaatacaaaactccggaggaaagagaatttgcattctttatgtgcatgttcgtgcaacaatggtccccctactgggaggtaaattccctgcaagtgcactaaaagaggagcaggttcaagcatactgggaagaagaaaggcaaggcatgcataggattctggatgactatcttcgtatttgtcaacggatgggggtgagagcagagaaactgcatattgaaatggatagcattgaaaaaggaattttagaactcatctcccagcatggcatccaaaagcttgttatgggagcagcatctgataagtactataatagaagaatgatggacctcaaatccaagaaagccatctctgtgtgtaaacaagctccagcttcttgtcatatacagtttgtctgcaaagggcgcctaatacacacaagcttccattcttgggagccctgcgtccatattcaaaccctagctgtcttcattgtggctgactttatctcttctattcagtatatagtgccttcattgcactcaagacttagttccaatgctttcattgcacatcagaacctcattgccccactgtttgctgctgctgccagcttcttttcaaccagaaaggcctaccaggaggttcatctggcccagctcaaccagatctccaaagttccccaccaccacagattaccaccttggccgccattccacattgaaccattctcattttgtttgtttggttcccctctctctgttcaagtgccaaactctgtgagatctttgagatctcagtctgtaacacttggtcaagatcgccgagcaaatctgaccaatcctgctctagagttatttcgcagagtaaggtctgccaatgatgggcatggagcaagctttatgactgtttcttctccagaagacactgaagggttttcaactccacatgacaggatgggtaccgaagatggtggaatggatgatactatctacgaacaacttgagcaggctagagctgaggctgagaatgctacgctaaatgcataccaagaaactgtaaggcgtaggaaagctgaaaaagatgcctttgaagctatacgcaaggttaaagcttctgaaagtttatatacagaggagttgaacctgagaaaaatgacagaggaaaaacttaggaaagaaaaggaagaacttgagagtatgaagagcttgagagacaaagttaaggaagaactctgccttgctcttgatcagaaggaatcactagagagtcaaattgcatcatctgaacttatggtaaaggagttggagcagaagattttatctgctgtggatctgttacaaagctacaagaatgaacgagatgaattgcagatgcagcgcgataatgcattgagagaggctgaagagttgaggaaaaaacaaggagaggcctcaggcaccaatgtgcctcaattgttctcagaattctctttttcagagattaaagaagcaactagtaacttcaatccatcctcaaagattggagaaggtggatatggaagtatatttaaaggtgtcttgcgacacactgaggtggctataaaaatgttgaactctgacagcatgcaaggacccttggagtttcaacaggaggttgatgtgttgagcaagcttaggcatcctaatcttatcacactcataggggcctgtccagattcatgggctcttgtctatgagtatttacccaatggaagccttgaagatcgtcttgcctgcaagaataacacccctccgttgtcatggcaagctcgaattcgcattgctgctgaactatgctccgctctcatctttcttcattccagtaaacctcacagcgtagtgcatggtgacttaaaaccctccaacattctccttgatgcaaaccttattagcaagcttagtgactttggaatctgtcgaatattatcaaactgcgagagttccagtagcaatactacagagttttggagaactgacccaaagggaacttttgtctacatggatcctgaattccttgcctcaggggaacttactccaaagtcagatgtttattcatttggaatcatattgttgagattgttgactgggagaccagcattgggaataacaaaggaagtgaaatatgcattagacactggaaagttgaaatccctattggatcctttggctggagactggccatttgtgcaggctgaacagttggctcgcttggctttgaggtgttgtgatatgaatagaaagagccgaccggatctttattcagatgtctggagggtacttgatgcaatgagggtttcttctggaggtgcaaactcctttggattaagttctgaagggcttttacaacctccttcatattttatttgtccaatcttccaggaagttatgagagatccacatgtagctgcagatggttttacatatgaagctgaggctatacgaggatggcttgatggtggtcatgacaattcaccaatgactaacagtaagcttgcacatcacaatcttgttcccaaccgcgctcttcgctctgcaatccaggactggcttcaaaaccactga

SEQ ID NO: 4088 - DNA, 1926 bp, Glycine Max
atggcttcccacgttgctcttcttcgtgtccctcctcctctttcaatctccactcaacgcttccatgccaaacagatttgcataaacggactcaaactcaccaacacttcttcttcttcttcttcttcttcttgttttccatgttccataacaacacaaagagggtcttgttcctctgtgattacatgttcatcttcaaatggcagagacccaaattcggtggatgaggaagatgtaaaacaagtggagcgcattctcgaagagaaacgacgagctgcattgtctgctaagattgcctctggggaattcaccgtgaagcagaaatctggtttactttcaataatggagggcttggcaaaggtgggggtgcccaatgaagttctggaatttttgtttggttggtttgaagggggtggcgagcacccgaaaattcctgaggcaaaagggtcaatcaaagctgttcgaagtgtggccttcttcattcccttgtatgaactttacctcacatatggtgggatttttaggttgacctttggaccaaagtcctttctaatagtatcagatccctctattgcaaaacacatattgagagagaattcaaaggcttattcaaagggtatcttggctgagatcctagactttgtaatggggaaagggcttatcccagctgatggtgaaatatggcgagttagacgtcgtgctatagtcccagcattgcaccagaagtatgtagcagctatgattggcctttttggacaagctgcagatcggctctgccagaagctagatgctgctgcatctgatggagaagatgttgagatggaatcacttttctctcgattgaccttggacatcattggcaaggcagtattcaattatgattttgatagtttatcaaatgacactggtatagttgaggctgtttatactgtactgagagaagcagaagatcgaagtgttgctccaattccagtctgggagatcccaatatggaaagacgtatcaccacgtctaaggaaggttaatgcagctctcaaattaatcaatgatacgcttgatgatctgatagcaatatgcaagagaatggtggatgaagaagagttacagtttcatgaggagtacatgaatgagcaagatccaagtattctacacttcttgttggcgtcaggagatgatgtgtcaagtaagcaacttcgtgatgacttaatgaccatgctcattgctggacatgaaacatcagctgctgttttaacttggaccttttatcttctatccaaggagccaagagtcatgtccaagctccaagaagaggttgactctgtacttggagatcaatatccaactatagaagacatgaagaaactcaaatatacaacccgagtgatcaatgagtcattgaggctttacccacaaccacctgtgttaattcgccgctctcttgaggatgatgttcttggagagtaccctataaagagaaatgaagatatctttatatctgtctggaacctacatcgcagtccaaaactgtgggatgatgctgataaattcgaacctgaaagatgggcattagatggaccaagtcctaatgagacaaatcaaaacttcaaatatcttccgtttggtggcggaccacggaaatgtgtaggtgatttgtttgcttcctacgagactgtggtagcactcgcaatgcttgttagacgattcaactttcaaatagcagttggagctccaccggttgagatgactactggagctacaattcatacaacacaagggttgaagatgactgtaactcacagaataaaacctcctattgtgccctcattacagatgtcaactttggaagtggatccatccataagcctttctgatcaagatgaagtaagtcagaaaggcgaagtttaccaggctcaggctcagtcctaa

SEQ ID NO: 4089 - DNA, 1119 bp, Glycine Max
atggcttccctcatgagcaccatcctcatgcaaaggtcttcttctacttcacttgctgctgggaggttgttctccacaacaacagcaaccattattgattccccttcacttgctcagagaatcagagatttgcctaaggacctccctggaaccaacatcaagaaacatgtttctcagctcattgggaggactccacttgtttatcttaacaaagtcactgaaggatgtggagcttatgttgctgtcaagcaagagatgatgcaacctactgccagcatcaaagacagaccagcatatgcaatgatcacagatgctgaggaaaagaatctgataactcctggaaagacaactctgattgagcccacgtcaggcaatatgggtatcagcatggcatttatggccgccatgaagggatacaagatggttttgaccatgccctcttacacaagcttggaaagaagggtgaccatgagagtgtttggagctgaattaatcctcactgatccagccaaaggaatgggaggaacagtaaagaaggcttatgaacttttggaaaacacaccaaatgcccacatgctgcaacaattttcaaaccctgccaatactcaggtgcattttgaaacaacaggtcctgagatatgggaggatacaaatggacaagttgacatatttgttatgggaataggtagtggaggcacagtctctggggttggacaatatcttaaatccaaaaatcctaatgttaagatatatggagtggagccaagtgaaagcaatgtgctgaatggtggtaaacctggtcctcatcatataactggcaatggagttggattcaaaccagacatattggacatggatgttatggaaaaagttcttgaggttagcagtgaagatgcagttaacatggctagggtgttggcattgaaggaaggactcatggtagggatatcatctggagctaacacagttgcagctctcagattggctcagctgcctgagaacaaaggcaaacttattgtgactgttcatccaagtttcggcgaacgatacctgtcatctgtcctgttccaagagcttcgtcaagaagctgaaaacatgcagccagtagcagttgattaa

SEQ ID NO: 4090 - DNA, 1488 bp, Glycine Max
atggctttggggaacaacagtcaccagcttctgtcaaaaattgcaaccaatgacaagcatggagaaaattctccttactttgatggttggaaggcctatgattcaaacccatttcaccccacaaaaaatcctcagggtgtcatccagatgggtcttgcagaaaatcagctctgctttgatctgattcaagagtggataaggaacaatcccaaggcctccatttgcactgctgaaggagtgaaccagttcaaatatattgcaaactttcaagactatcatggattgccagagttcagaaatgctgtggcaaattttatgtcaaaagtgagaggtgggagagtgagatttgatcctgaccgtattttgatgagtgggggggccactggagcaaatgagctaataatgttctgtttggctgatcctggagatgcttttctggttcctagcccttattatccagcatttgtccgagacttgtgttggagaacaaggacgcaactaattcccgtagagtgtcacagctccaacaattttaagataacaagagaggctcttgaagaagcatatgaaaaagcaaaagagggtaacatcaacgtgaaagggttgatcataacaaacccttcaaaccctttgggaaccacccttgacagggaaacactgaagagcatagtggggttcatcaatgaaaagaacatccatttggtgtgtgatgaaatctatgcagcaacagtgttcagagcccctagctttgtgagtgtctctgaggtgatgcaagacattgagcattgcaaaaaagacctcattcacattatttatagtttgtctaaggatttgggacttccagggttcagagttggaatagtttattcatacaatgatgaagtggtgaacagtggtaggaaaatgtcaagctttggattggtctcatctcagacacagtattttcttgctgcattgctttccgacgacgagttcgtggagaggtttctggcagagagtgcaagaaggttggctgcaaggcatagccacttcacaaaagggcttgaaaaggtgaacattacttgcctgccaagtaatgcagggcttttcttttggatgaacttgaggggtttgctcaaggagaaaacatttgagggtgaaatgatgctgtggcgtgtgatcatcaatgaggtgaagctcaatgtgtcacctgggtcagctttcaattgttctgagcctggttggtatagggtgtgctttgcaaacatggatgatgaaactgtggatgttgcactcatgagaatcagggcttttgttggcaaggagacagggaagccaccaaaggaactcaaacgttggaaaaaagatttgatgagaatgttatgtcacctcattcaccaatgcctcactcacctcttgtcagagccacttagttggaccagcaagcataccttcattaccttgagagattcatatgtattaagggttaattacaaaaatgttctttaa

SEQ ID NO: 4091 - DNA, 603 bp, Glycine Max
atgggaatgatagtggattttgaaaatgaccaaaacgacgccgttctggttccgccccctaacttcgccatggttgaagactgcgttttccgatccagcttccccaccccttccaatttcccctttctccaaaccctaaaccttcgctccatcatatacctgtgccccgagccttatccggaaggaaatctcgagttcctccgctcgcagaatattcgcctctttcaatttggaattgaggggaaaacggacgtttctatgcctgttctcaaggattctatcatggatgcactgaaagttttaattgatgtgagaaatcaccccattttggttcattgcaagcgaggaaagcatagaacaggttgcctagttggttgcttgcgaaaattacagaactggtgtttgtcctctgtgtttgaggagtaccaacgatttgctggtgctaaatccaggacaacggatttaacattcatagaaatgtttgatgttctaagtctgagtcagtgcctttacagcatcatctaccagtaccatggttcaaagaagcgtcggttgttgtataaagatgaaaacttacagaagccccgactgacatcattttag

SEQ ID NO: 4092 - DNA, 555 bp, Glycine Max
atgggaggttgctgttgttctgccagaaaacctcatctgcaaggggcaccagtgtattactatggcccaccaacttttgaagagcgtgagtctttaacatctaatgatggcttgaatgcttcagtcaatgctggatttcttgttggtttgaacctggaagcatccatgcctgatactttccagccccctcctgtgcctctaccttatgatatggtcttgggaggttctgcatcaacagattctgaatctggcagagaaacagttagtagttttgaaacttcaattacacttgaagatgttgaagaatcagattgtaaagctcaagccaattctgctcctacatctccaaagaaggcacaactatcaaaatcaaatgtaactcaagaattagtgacagaagaagaggatgtctgtccaatttgtcttgaaggatttgatgttgaaaatcctagaaatttgacaaaatgtgaacaccattttcacttatcatgcattcttgagtggatggaaagaagtgactcatgtcctatatgtgatcaggagatgatattttga

SEQ ID NO: 4093 - DNA, 573 bp, Glycine Max
atgggcatcgccacaatcaaaatgggaggcaactccgactccaactgttccatcactccacgccattacaacacccacaaggtgttccttttctgcaactacattctcttgggtgcagcctccagctgcatcttcctcaccctctccctgcgcctcattccctctctatgcggcttcttcttcatccttcttcaggtcttcacgattgcgggtgcagtctcgggttgtgctgctgtgggggctaataggtggtactctgcacacatggtggccactgttctaacggctatctttcagggttctgtttcagtgttggtgtttacgcggactggcgattttctgggtcagttgaaatcttacgtgagggaggaggatggtgctgtgattctcaaattggctggtggactcaccattttgatctttgtcttggagtgggtagttttgactcttgcatttttcttgaagtattatgcttgtgttgaggggaatagtggcgctgttgtgcctgtgaggagtgggaaggtgcagcaggatgaggacttgaaggattggccttggccttttcaagtttga

SEQ ID NO: 4094 - DNA, 2184 bp, Glycine Max
atggggagcacgtggcttcttcatgtcgttgttgctactgttgcgattctgtgtggcatctgcgcagctgaaagcaatgaaggagttacgcacgtcagaggaggccccgattctgtggtttgggtggttcagctttccgatcttcatttcagcgttcaccatccaaacagagccctcgatttcgccaatcttgtgggccccgctctttccgttatcaacccttccctcgtcctcatcaccggcgacctcacagatggtaaaagcaaggatttgctgacaatgaagcagaatgaggatgaatgggtggaataccggactgtactggacactgttattaagagaagtagactccagaagagcttgttttttgacctcagaggcaaccatgacagttttggtgttccggttgtcggtgcttcctttgatttcttttctaaatacagcatcaatgggcagttaggaagaaatgggagcgtcaatagtgtaacccttgagactcgagactggaaacatctctttgttgggtttgatagcacaatgttaactggcttacgaggtccaacgaatctttttgggcatcccactgatcaattactaaaggacctagacttggaactctcacagtgggattcacagtcagaaaaactagttaccaaaatttcctttgggcattttccactctcattttctgcaccctctagttctggaaggacattggaagatgttttcctaaagcattccatatcagcttacctgtgtgggcatctccatactaaatttggtatgaacttaaagcggcaccatcaactggatgatcattcatcatccttgcagaaactttttcagtttaatatacaccagagttcttttgaaagtactgcaaactgttcaatgggagccccaccaattcaagagttttgggagtgggagatgggggattggagaaagagtagagcttttcgaattctagccattgatagaggccatgtttcatatgttgatactgatttcaaatctgggaccaaacgtgcaattatattgcccacttttccattagactctcgcttcatgttaacatcttcatgccgtcacaactatgaatgtcaatctgtggccccttcatcttatgagacaatccgagctctggtattttctctttctccaattgtatcagttgtagctagagtctatgattcacgatctggaaaccttgatttagttctagaaactcagatgatcaagcattctggtgataactccagggggaacctctatgttgctccatggaattacagagcatttgaggatgcttctcctgataggttttggcttcaaatcgaagcaaatgacatcgcaggcagatcaactttgactgaattgaggccgttttctatcaatggtcatagcctcaaactttcatggggctggaaggagtttttggtcatgggatgtcaatgggcttccctttattacccattattttggtctgctctttactttttgttcatcttccttcttcttccaaaagctcttcttgtttttccaaagaagatatacacttacaagaacttcatcgccaataaaggcatagtaaatggtgtattatggtttctccaggagctctgcaggatccccacattatggtttggttggataggatacctattttatcttatgttgtgcccctggtttatggggcaagtttttactgaagggaaaaatatggtatacatgacctatatgggttgggccatagagacttctaatggaaaggggaaggttgagtatgttgggtctccagatattatggtggtggttcttccccatctattatttgtggttttgcctgcaattttggtcactggtgctctgacggctgaaagagcaatttaccgggaacacatgttagcatttttggtaaagaaaaaagatgatatttgtatggactctagaaaatctgtattgaatggcagcatggtatctaatgttcaccttagcaagcgattgattcggaagcttctttttgtggtgtgcttggcaatatgttggaagcattttatgaattgcagaactcttctaaaagcttatgagatgaacccagtactccatttcttaggctatgcttattgtttgaagaaccaaaaaataccgatgcagtatgcaacaagttatcgtgctggctga

SEQ ID NO: 4095 - DNA, 540 bp, Glycine Max
atggggcacaaagaaaaatcaaaggacctaaaagaaaagagattgcaacagatttctcttttgagaaccattccttattctgatcaccagaggtggtggtccaaggaaactgttgctgtggttacaggtggaaacagaggaattgggtttgagatatgtaggcaacttgctggtcatggagtgactgttgtactgacttcaagagatgaaagtgttggtgttgaatcagctaaggtcttgcaagaaggtggcttcacggaggtggcttgtcatcaacttgacatattggatccttcatccatcaaccaatttgctgaatggttgaaagaaaattatggtggtttagacattctgttttgtccattttttttattaccgttgtggactagcttattttctcaacatccactgcaaaagcttataattccatgtcaattggccatttctaaaagcaaagttccaagtacttatgatttggatgttgctacttggctacttggcttccatgaaccctttggatggttcaagttgtatttataa

SEQ ID NO: 4096 - DNA, 1455 bp, Glycine Max
atggggctcttgtggaaaactcacacgaggatacaggtgattagaacattttttgcaatccttttggttgcactgctgagttcagagagagtagagagcagaaaagccaaagttgtgaccacttccttggagtacaatgctataaactgcagagctcacagtgctgcattgacagattttggtggtgttggggatggaaaaacatccaacacaaaggcatttcagtctgcaataagtcacctgagtcagtatgcttctgaaggtggctctcagctctatgttcctgcaggaaaatggctcactggtagcttcagcctcactagtcacttcaccctctatcttgacaaagatgctgttctccttgcttctcaggatataactgagtggcctgtgcttgaacccctcccatcatacggtagaggaagagacgcaccagcaggaagattcacaagcctcatatttggaacaaacctcactgatgttattgtcacaggtgaaaatggcaccatagatggtcagggtgagttttggtggcagcaatttcacaggaaaaagttgaagtacactcgcccatacctgattgaattaatgttctcagacaacattcaaatctcaaatctaactctactcaattccccatcatggaatgttcatccagtttacagcagcaatattattgtgcaaggcatcaccatttatgctcctgtcacatctccaaacactgatggcatcaacccagattcttgcacaaatgtaagaattgaagattgctatatagtttctggggatgactgtgtggcggttaagagtggatgggatgagtatggcataaaatttgggtggcccaccaaacagctagtgataagaaggctaacatgcatctcaccatacagtgcaaccattgccttgggaagtgagatgtcaggtggaatccaagatgtgagagctgaggacatcacagcaatccaaacagaatcaggtgtcagaatcaagacagcagtagggagaggagggtatgtgaaggacatatatgtgaagagaatgaccttgcatactatgaaatgggcatttaagatgactggtgattataactcacatgctgatggccactatgaccctaatgccttgcctgagatcaaaaacatcaactatagagatgttgtggctgaaaatgtgaccatagctgctaggtttcaaggaatctccaatgacccctttacaggaatctgcattgcaaatgtgacactaaggatggcagccaaggccaagaagcagccttggacctgcactgatattgaagggatgacgagtggggtgacccctccaccttgtggtctgttacctgatcaagggccggagaagatcacagcatgtgatttcccagcagataatctacctattgacatagtggagcttaagaaatgtactaccaccatgacatatgttgaagtgtag

SEQ ID NO: 4097 - DNA, 807 bp, Glycine Max
atgggggagctttacgcgttggacttcgatggagtcatatgtgatagctgcggagaaagctctctctctgctctcaaggctgccaaagtgagatggcctggtttgtttgatggggtggattcaaccacagaaaattggattattgaccagatgcacacggtgcgaccagtagtggaaactggatatgaaaacgttttacttgtgagattgttgcttgagagcagaacaccaaccatccggaagtcttcggttgcagaggggctaacagttgagggtatattggagaactggtcaaagttgaagcctattatcatggaagaatgggatgagaagagggatgatctgatagatctttttggaaaggtcagagatgaatggttggagcaggattttgctacttggattggtgcaaacagattatatcctggtgtttctgatgcattaaaatttgcaagctcgagagtgtacattgtcaccacaaaacagagccgctttgctgatgctttactccgagagcttgccggagtgaccataccacctgaaagaatatatggccttggaactggtcctaaggtagaagttctgaagcagctacagaaaaagccagagcaccaaggactgacactgcgctttgttgaggatcggctagctaccttaaaaaatgtcatcaaagagcctgagttagaccaatggaatttgtatcttggtaattggggttacaacacccagaaagaaagagaggaagctgctgctatccccagaattcatgttcttgagctctccaacttcagcaagaagttgaaatag

SEQ ID NO: 4098 - DNA, 1464 bp, Glycine Max
atggggtcctgcttctctgcggaaagcaggagccctcaccccaattcaccaaattcatcatctttcaggaagagcaagagcaactccaagaagaggcttggatcaagaacctcttcatttgagtattggaggaatgagcctctacataggatccctgggaggatcttcctcaatggctcatcccaagttgcatccttgttcactcaacaagggaagaagggtaccaaccaggatgccatggttgtttgggagaacttttgttctagacaagatactattttctgtggagtttttgatggccacggtccatatggtcacatggttgcgaaaagagtgagggattctcttcctctaaaactgaatgtccattgggaacaaagtgcatctggtgaagaagtcctcaaggagattagcgttaatactgcaggaagcatgaattcagaagaggctgcatttgcatctgctgatgatgaatccagggtatctgttgatgccgaggaaacagaaaaacacccagaaatctttcagacacttaaagattcctttttgaaggcattcaaagttatggatagagaactgaagacccaccaaagtattgattgcttctgtagtgggacaacagcagtaactctggttaagcagggacatgatcttattattggaaatgttggtgactctagagctgtgctgggtacaagagagaaagacaattctcttgttgccatccagttaactgtggatctaaaacccaatcttccagccgaagaagagagaattcgcaaatgtaaagggcgtgtttttgctcttcaggatgaacctgaagttgctcgagtctggttgccaaacaatgactcacctggccttgccatggcaagggcatttggagatttttgtcttaaagattttggcctgatatctgttcccgaagtgtcatacaggcgactcactgagaaggacgaatttgttgtcttggcaacagatgggatttgggatgttctctcaaacaaagaagtggtggacatcgtggcagccgcgccaaggcgtgcctcggccgcacgggcgctggtcgagtcagcggttcgctcatggaggtacaagtatccaacctccaaagtggacgactgtgccgtggtttgcctctttctggactcggattcgcacaaagtgtgtagtgcttccaatgtcatcaagtccaaggaacaacctagttcaggtatccaagtccacaatggcgacaacggagatgttcctgcacctactggtctggcaaggtcaggaacttgcagggaaaacaatgaagataacaacaacaaccacaaccacaaccataaggaagaggaaatagatactgatgcagaaatagagtggtctgctctcgaaggagtgtcgcgtgtgaacacattactaaacctcccaaggtttgaacctgacaacaaagacaaggggatgagaaaacacaaatga

SEQ ID NO: 4099 - DNA, 1851 bp, Glycine Max
atggggtctatgaatttgttaggtttttctctctctcctcaagaacacccttctagtcaagatcactctcaaacggcaccttctcgtttttgcttcaaccctgatggaatctcaagcactgatgtagcaggagactgctttgatctcacttctgactcaactcctcatttactcaaccttccctcttacggcatatacgaagcttttcataggagcaacaatattcacaccactcaagattggaaggagaactacaacagccaaaacttgctattgggaacttcatgcagcaaccaaaacatgaaccacaaccatcagcaacaacaacaacaacagccaaagcttgaaaacttcctcggtggacactcatttggtgaacatgagcaaccctacggtgccggtattggccggtggcggcggcgctccatagggttatccatgataaagacatggttgaggaaccaaccaccacactcagaaaacaacaataacaacaacaatgaaagtggtggcaatagtagaagcaagagttcttctgataacaaacaaccacataccacggctgcacttgatacaacccaaaccggagccattgaaactgcacccagaaagtccattgacacttttggacagagaacttctatctaccgtggtgtaacaaggcataggtggacggggaggtatgaggctcacctgtgggataatagttgtagaagagagggacaaactcgcaaaggaaggcaaggaggttatgacaaagaagaaaaggcagctagagcctacgatttggcagcactaaaatactggggaacaactacgacaacaaattttccaattagccactatgagaaagagttggaagaaatgaagcacatgactaggcaagagtacgttgcgtcattgagaaggaagagtagtgggttttctcgcggggcatccatttatcgaggtgtgacgaggcaccatcaacatggaagatggcaagcgaggattggaagagttgctggcaacaaggatctctacttgggaactttcagcacccaagaggaggcagcagaagcatatgatgtagcagcaatcaaattcagaggactaagtgctgttacaaactttgacatgagcagatatgacgtgaaaagcatacttgagagcaccactttgccaattggtggtgctgcaaagcgtttgaaggatatggagcaggtggaactgagggtggagaatgttcatagagcagatcaagaagatcatagtagcatcatgaactctcacttaactcaaggaatcattaacaactatgcagcaggaggaacaacagcgactcatcatcataactggcacaatgctcttgcattccaccaacctcaaccttgcaccaccatacactacccttatggacaaagaattaattggtgcaagcaagaacaagacaactctgatgcctctcactctttcatggattctgcttccattgacaatagctcttcatctaactctgttgtttatgatggttatggaggtggtgggggctataatgtgattcctatggggactactactactgttgcacttggttatgaaagtgtgtatggttctacaactgatccttatcatgcacatgcaaggaacttgtattatcttactcaacagcaaccatcttctgttgatgcagtgaaggctagtgcatatgatcaaggatctgcatgcaatacttgggttccaactgctattccaactcatgcaccaaggtctagttttctttcactatctctaactagcaggatccttatttcactaggaatgtgtggacagatatcattgggatgtttttattatcagcgagctttgtaa

SEQ ID NO: 4100 - DNA, 348 bp, Glycine Max
atgggtactcttccaattggcattaggaagaattggctaacatactttaagtatgaagaagtaagggacacaccaagagaaacaagaaacattcttttgataatcttcactttggttgcagtagtgacatttcaagctggagtgaatcctcctggtggagtttggcaagagaataaggatggacacttgcaagaagagcaatatatgcttcagatgagcatgcttactatgtcttcctcatcttcaattctttggccttttttaattccatctttgttattttgttactcactcacaagtttcctttccattttgagatatgggctgccactgtttccatggctatga

SEQ ID NO: 4101 - DNA, 447 bp, Glycine Max
atgggtcctaatctgtctgagattctgaagggtaagttgagtttgggggcaaggattatacaagaaggaggaagacggaacatcttcaagagtgtttttgggatgcaagaaaaagagctattgttgaaggcctctcagtgttatttatataccacagctggtcctattgctggaattctctttgtctcaactgcaaaggttgcattttacagtgaaaggcccataaccttctcttctgtgacaggagagttagtcagggcaccttacaaggttttgataccaataaggagaataaaagaagtcaatgaaagccagaatgtgaacaaggcagaacagaagtatatagagatagtgactaaggatgattctgaatttaggtttgtggggtttttgcggtatgagaaagctctcaagcatctcaataaagctatttccatggccaataaa

SEQ ID NO: 4102 - DNA, 981 bp, Glycine Max
atgggtcgtcgccaaaacgactcagatttcggtagattcgcgattctcgtcctcttcttgataggtgcaatctcctgctccgcggtgtaccttttccttactgtggtcttcaggcccagcaccgagtctctgccttcagtggatgatgatgtgggggttgcagaagaggagaattgttgcagagggattgaaaatttggagctttggggtgatgctgtgaaatggggttctgaatttaggttgaattcctcggaggaatgttgcatggcttgtaagagaatgtgtagcggcgagggagggccttgtatgtgtaattcatgggtgtattgtggagatagagaggcttgtggacctagatttggcgagggttggttaaaaaaacaaaaggatgctttaaatcctgatcgacgagactcgggagatctagtaatgtggacttctgggtttgtctttgataagggagagggaattgttggtatggaaactgaccatggaattcttcgaataaaagttttgcctgaatgtgctccacattctgtttcctacattctggagctgttggcattgccacattgtgttggttgccagcttcatcgtgctgaaagccgaggaagcttttgggattcagaaggaaaccacattaaaaaggctccatatggtcctcctttcgcacttattcaaggaacattggaatcctatgggtctatgttcaaggatattcctaaagagcactgtcctaccataagaagaggatctgttgcatgggttggttctggtccagaattcttcatcagcctcgccgatcacggggaatggagaaatgcatacactgtgtttggttctgttctatctgaagatatggaaattttagagaaaattgctcagcttccaactaaatcagaaatttggaataatattaaagtttctgtcttggagaacccagtttcattacggtttcggagaatgaacaaaaagtcttaa

SEQ ID NO: 4103 - DNA, 1626 bp, Glycine Max
atgggtgaggacaaaaccacacaactccccagaagaatgaccaggtcttcagcttcatcttctgcatccacttcaaataacgtagctgcagcaaaagtaacttgccttgaacctctaacaattaatgaccttttagtcggaggagatcccatcagtctcaacgacataatatctagctttcctggtagaagtagccagattcttgaggtcgtgcgtcatttgggacctttgaattcaccaatccttcctttgtttgtgtatggaagttcttctactggaaaaaccagtatcattcttcaattattcaggcatctcaacaggcctattgtttattctagttgtaggacatgttataaccagaacatcttgtttgaatctattctaaatcagctacttctccatagaaaaaatgctgccaatggttattcgaatgcaaaacgctgtgaaagaccatctgattttgtcaattttcttcgagaagcgttgaccaatgttataaacaatctgaagaagtcagagaagttgatctcaaatgagatgacacaagggaaaattggaaatatgatctacttggtgtttgacaattttcagcttgttagggagtgggataagagttcaactatattgcccttgctgtttaatctctatgatctgctaaatatgcctgaggtgggtttgatttttatcagcagtacttctccagataccttttactctaacatgggttatgtggagcctatccccatttactttcctgattacacagaagaagatattcgtcaaatattattgagaaaccaagtgaaccagaagctatattcctcatttctggatgtatctctgaagtctttctgtggaattactaagcagattgatcatttatctgctgccttaaagccactatatgaaaagtattgtgagcctttaagtgataagggaaagggagttgctcctaatcaagaaatgaagcgaaggctgcttgctcatatcaaccctcatattgcctcctctttgaatgagatatttaaggtttcatctctttcttcaactgaagttgagatccgtaaagaggaaaagcggaagggaaataataggagattggagcaatctgaagaacttggcagtcttgattttcatgtatctactagtgcaaaatatcttctgatttcagcattccttgcctccagaaacccagcaactcttgatgcttcactttttgattccaaaggtggttctgataatcggaagcgaaagaggaagccctctgagaaagcacaggaacggaaggaaactttagaacaggaactactaatgaaaggacctggaactttcccactggagaggttgttagccatctttcaatgccttgtatcagttgcagaagaaccatctgacgagcaggagcaaaataatgatggattaggagttgaaggtggcaatggtggactgatgtctgatgttcttttacagctatccagtctctgcaatgctaattttatattcaaaggaaggagctgtcccattgaaggctcaatgcggtatcgaacaaccatatctgaagaccttgctctgaaggttgcaaggagcttaaagttcccattatcaaagtatttgtataggagttag

SEQ ID NO: 4104 - DNA, 3348 bp, Glycine Max
atgggtggcctcaggtcatccctctggagcaaggactgtgtccctctgcacagaagattgtgtacctcaaagtcatcaatcgcacgttgctcgttgtctcccccactcactttgaactctggagcacttcccagagtgagattggggaagtacaagagagattcagattcattgcagagggaaggagaaaacttgcaggccgtgtggagccctgatgccaaattaatcgctattctgacatctgcgttctttcttcacattttcaaggtccagctatcagataaaagaatacacactggtgggaaacaaccctctgctttgtgcctagctactatttctcttctgcttacagagcaagttccttttacagcaaaggatttgtcagggagcaatattgttagtgataacaaacatatgctacttggactttctgatggaactttatacagtatgtcttggaaaggggagttctatggggcttttcaattttatccacaacctactgctagctttgacaattctcaaatgccacttactctagagaatggtctttctcctaaaagtcacccaaaggttcttatgtccaatcacattattcctagaaagtctgaaatcaaccaactggagctttgccttccattgaggttcctatttgtcttgtattctgacggggaacttgtctcatgttctgtgagtaaaaaaggcctaaagcaagttgactgtatcaaagcagaaaagagattggcttgtggtgatgctgtctgtgcttcagtagctctagagcagcaaattcttgctgttggtaccaaaagaggaatagtggagttgtatgatttggctgaatcagtatcacttatacgtgcagtctctttgtatgactggggatattcaatggatgacactggccctgttagtttcattgcttggacacctgataattccgcttttgcagttgggtggaagttaagggggcttacagtttggtctgtttctgggtgtcgcttgatgtcaacaatccgacaaataggtttaagttctgtgtcttctccaatatctaagccaaaccatgattgtaagtatgaaccattgatgggtggtacctcactgatgcagtgggatgaatatggatatagactttatgctattgaggtggggtcttcagagagaattctatcgttctcatttgggaaatgctgtcttagcagaggtgtttcaggcactacatacatccggcaagtgatttatggggaagaccgtttactcattgtgcagtcagaagagactgatgaactcaaaatgctacatcttaagcttccagtttcttatatttcccaaaactggcctgttcaacatgtggcagctagccaggatggcatgtacttagctgttgctggtcttcatggtttgatattgtatgatatacgattgaaaagatggagagtatttggagatgttactcaggagcaaaagattcagtgtaaaggtttgttatggctggggaagattgtcgttgtctgcaactatgttgattcatcaaatacgtatgaattgctcttttacccaagatatcaccttgatcaaagctcattactctgtcgaaaaccattgcttgctaaaccaatggtgatggatgtgtaccaagattatatgctgcttacatatagaccatttgttgtccacatattccatgtgaagttatttggtgaattaactccttcaggaaatccagatttacagctttctgcagtacgagaactttcaattatgactgccaagagccatcctgcagcaatgcgattcattcctgatcaacttccaagagaatctatttcaaacaatttggttttgtcagattcattaacaagagagccagcaagatgtttgatattgagagcaaatggggagctttcacttcttgacttggatgatggacgggagagaaatctcactgattcagttgaactattttgggtcacctgtggtcagtctgaggataaaacaaatttgattgaggaagtttcatggttagattatggtcatcgaggcatgcaggtttggtatccatctccaggtgctaattcttttaagcaggaagatttcttacagttggatccggagctggagtttgatcgtgaagtataccctttgggacttcttccaaatgctggtgtagttgttggtgtttcccagagaatgtcatttccagcaagtgctgaatttccatgttttgaaccatctcctcaagcacaaacaatactgcactgcctactccgccatcttcttcagagggacaaaattgaggaagctttaaggctggcagagctatcagctgagaagcctcatttttcacattgtctagagtggcttctttttacagtatttgaagcagatatatccaggccaaatgtgaacaagaaccagatctcagttgttaaacatgctaaaaggtctcttttagagaagacctgtgacctgatcaggaattttccggagtaccttgatgttgttgtaagtgttgcaagaaaaactgatggtcgtcattgggcagatttgttcactgctgctggaagatcaacagaattgtttgaggaatgctttcaacgtagatggtatcgcactgcagcttgttatatacttgtgattgccaaacttgaaggtcctgctgtcagtcagtactgtgctttacgattattacaggcaacacttgatgaatcattgtacgagcttgctggggagctggtgcggttcttgctaagatctggtagggaatatgaccaagcatcaaacgattcagataaactgtctccaagatttttaggctattttctttttcgttctagtgagcagaagcaatcattggataaaagcacctcattcaaagaacaaagttctcatgttacctctgttaagaatattttagaaaaccatgctagttacctgatgtctgggaaagagctctccaagcttgttgcatttgtaaaaggaactcagtttgatttagtggagtatctacaacgtgaaagatatggaagtgctcggttggagaattttgcttctgggcttgaactaataagccaaaagcttcaaatgggaacattacagagccgtttggatgctgactttctcctatctcatatgtgctctgtcaagtttaaggaatggatagttgtcctggctactctcttaagacgttctgaggttctttttgacttattccatcatgatgttcggctgtggaaagcatacagcaccaccctggagtcacacccagcatttacagaatatcaagatttgctggaagacctggaagagagactttcatcagttgcaaatgtagaaggaaaatga

SEQ ID NO: 4105 - DNA, 495 bp, Glycine Max
atgggtggtaaatctggcgtagtttggattttgctgccgctgatcgtcgccgcgtcgtgtctgttatcgccggcgacggcgaattcgacgacgatatacgaggagctccgggcgcagggtcttccggtggggcttctcccgaagggaatcgcgaagtactcgctgaacgctagcagcggggaattcgaggtgtggatgaaggaaccgtgcaacgcgaagttcgagaacgaggtgcactacgactccaacataaagggtgttctagggtacggtcggatcgggaaattatccggtgtgtcggcgcaggagctcttcctgtggtttcccgtgaagggaattagggttgatgttccgacctcggggctcattcatttcgatgttggtgttgcggataagcagttctccctctcgctctttgaagatcctcctgattgtaacccccaggcccaggttaatgttggtggtggtgaaggtgagcggagggctgcttggtag

SEQ ID NO: 4106 - DNA, 1470 bp, Glycine Max
atgggtgtggctcaaaacattcccgatgcggaggagggaaccttggagattggaatgggatacagaactgtttctggagttgctgggccattggtcattcttgataaagttaagggacccaagtttcaagagattgttaacattcgcttaggagatggtactactcggcgtggacaagtgctagaagttgatggtgaaaaggctgttgttcaggtctttgagggtacatctgggattgacaataaatttacaactgtgcaatttactggagaggtgttaaaaactccagtatcattggacatgcttggccgcatattcaatggttctggaaaaccaattgataatggtccacccattttacctgaggcttacttggacatatcaggaagttccatcaaccctagtgagagaacctatccagaggagatgatacagacaggaatatctaccattgatgtcatgaattctattgctagaggtcaaaagatccctctattctcagctgctggtctcccccataatgaaattgctgcacagatatgccgtcaggctggcttagtcaagcgactagaaaagtctgataatcttctcgagggtggaggagaagaggacaattttgccattgtgtttgcagctatgggagttaacatggagactgcacagtttttcaaacgtgactttgaggaaaatggctcgatggagagagtgacccttttccttaatctggcaaatgatcctacgattgagcgtatcatcactcctcgtattgctcttactactgctgaatatttggcatatgaatgtggcaagcatgttcttgtgatactaactgatatgagttcttatgctgatgctcttcgtgaggtatctgctgcccgagaagaagtacctggtagacgtgggtatcccggctacatgtatacagatcttgcaacaatatacgaacgtgctggaagaattgaggggcgaaaaggctctattacacaaattccaattctaaccatgcctaatgatggtattacgcatccaactcctgatcttacaggatatattactgagggacagatatatatcgacagacagttgtataacaggcaggtatatcctccaatcaatgtccttccatcattgtctcgtttgatgaagggtgccattggtgagggaatgacacgaaaggatcattctgatgtgtccaaccaggtctatgcaaattatgccattggaaaggatgtccaggcaatgaaagccgtggtcggagaagaagcactttcatctgaggacctggtgtatttggaatttttggagaagtttgagaggaagtttgttgcccaaggagcatacgatacacgcaatatcttccagtcactagatcttgcatggactttgcttcggattttccctcgcgagcttctccaccgtattcctgcaaagactcttgatcagttctacagccgagatgccagtaactga

SEQ ID NO: 4107 - DNA, 1131 bp, Glycine Max
atgggttcattgggtacatcaaatggaagagagctattgcttcacatgaatggtggcaagggagaaaggagttatgcaaacaactcctcattccaaaaaaaattaatgcttaaagccaaatcaatacttgaagaaaccataaccacactgtaccgtgattcttctccaaactgcatgaaagtggcagacttaggatgctctgtaggaccaaatacatttcttgtgacatcaaatattatcgacattgttgataccacaactacccttttgaattgtgaacaacccaccttccaattttatctcaatgatttatatggaaacgattttaataccatcttcaagtcacttcctgatttctatacaagattggaagaagataagggacacaagtttggttcatgctttattaatgctacccctggatccttccatgggaggctctttcccagtaattccataaacttatttcattctgccaacagtctacactggctctctcaggatccattatctgggttgactgaggaggagaaatcacttaacaagggcaattgtcacctagttagcacaagcccttcagaggtatacaaagcttactttaagcagtttcaagaaggttttaaatcatttctaaaatcacgttcggaggaacttgtgcctggaggagcaatggtcttggtgttaccttgcacttgcaaaaatgaaactctttcaaaaagcctttgggaagtaataagccttacactgaatgacatgctctcggagggtttgattgaagaagcaaaattggactcttttaacataccaacatatgagcctacaattgaggaaatcaggcatttgattaaggaagaagagtcattgtttcttcaaagattagaggttttcacggtgcctagggatgagggtgtaagtgaatgtggtgatgatgtttttcttgatggaaatataagagctgaattcatagccacatacacaagagctgcaatggagcctctcttatctgcaaagtttgacgcacaagttatagatgaattatttatccggtttcagaagaaacttgtgcaaataatgaaggtggagaaatttgagactgctaatttgatgatatccctgacaaaaattgcttga

SEQ ID NO: 4108 - DNA, 894 bp, Glycine Max
atgggtttatcactcttacggtgggttctgccgctgactctgttgctcacctgcgccctaggtttccaatcggacgagcttctcctcgacgacgaagagttcggcatcgaaggaggacgaacctcctttgattccgattcgcatccaccttccaccgcctccacctcgaggaagaggctttccgactcctcctccgattccaagatccagttccctctccaacacgctttcggcgactccgatttctccgacgccggcaacttctccgctcgcctcaagacttggagccacggcgcccagacgctgacgaagctgcggtttaagcgtgatcttttgactgacgttgagcagaggaaatttaaggagctgttgcgagaagatgatttctataggattagactgccgtccaatgttttgagtcctcccggccgggaatatattatttcttcagtgaaagcgcgatgtcttccaggggatggattggaggagcattttgtaatacaaatggaaggtgttaacatcttggctgtcagttatggtgccccaggggcttgcccttatccccgacaactgaagctgcctggaaagtggtctttcaagtcacacacagttctaaaaagcagtgaacaggcaccaagagctccaatatttactgaagaggcacttggcgggctggagggagacggtgaggctgtacagccaatagaaaggtccttttgggctaaatactggatgtacctgatcccgcttggactcatagtaatgaatgctgttactcaagctatgaatatgcccgaggaacaagctggcggacaacctggtgctccggcacagcagcaaccaggatctgcagtacagcgtggaccaagttctggtggtgtgcgtagaagatga

SEQ ID NO: 4109 - DNA, 513 bp, Glycine Max
atgggttttcccgtagggtacccggagctgctggttccgaaaatgttcctccacgcgctttccctcctcgcgtggctgcgctccctcgtcttcgccctcttccgcctcctccgcatctccgacctcctcgacaccgattccgccgcctctgacctccctccgccgcctccgccacgcgagccgactctctccgccctcctcatccgcgagtttctccccgtggcggcgttccgcgacctggcagccgccgacggggatcctccgccgtcgggctgcgccgtgtgcctgagcgaattctcctcggaagaagaaatccggtgtatggcgaactgcaagcacattttccaccggtggtgcgtggaccgttgggtcgatcacgatcagaagacgtgtccgctctgcagaactccgtttgtgccgcatcacaagctcgaagaatacaatcagcgactgtgggcagcttctggagtttcacagttttactaccaagacgattacacggcttctctctga

SEQ ID NO: 4110 - DNA, 144 bp, Glycine Max
atggtaaatgctctttcaaaaagaaacaagcaatgttcgttgcatatcccatgtatgattcaggtacggtgtttaattagcaatttttctgtcaagagtaccctcaacgatctttccaaaaaaatagaactcatcattatatga

SEQ ID NO: 4111 - DNA, 612 bp, Glycine Max
atggtactcacgtttgaaaggaaaaagtccatgttgtttctatttctttttttgtttctgacactctcgtggccccaagctgcagctgaagacagtgaagcaaatgctttgttgaaatggaaacaaagctttgacaactacagccaaggtctcttgtcaacttggagaggtaatagtccatgcagatggcaaggaattcagtgtgacaaatccaactctgtctccaacattgatcttccattttatggacttaaagagttggcccagacaatggaagtgaacgagaaatgtgatgtttttagttttggagtacttgctttggaaatcattatgggaaaacatccaagagatatcatttctcaacttatgtcaccatctatggcaccaactattaatgatttgctgttatctgaggttttagatcaacggccacctcaacctacgaaagtaattgatggggaggtgatcttaattgtaaggttagcacttgcttgcttgagtgaaaatccacgttctcgcccaaccatggatcaagtatctaaggcttttggaacagggaaatcacctttggatgaccaatttcctatgatcagactaggacaactccgttga

SEQ ID NO: 4112 - DNA, 813 bp, Glycine Max
atggtactccctcggccgcaccaacctgaaggctacccactggcaagaggtggccgacgccgtcaccgcgcagtgccccaacgcctcccccacggcgaaaaccgccgtgcagtgccgccacaagatggagaagctccgcaaacgctaccgcaccgaaatccaacgcggggcgcaacctccccttcccccgcggggggggacgccaacaccaattccccttcctcgtgggtccacttcaaatccatggactccatggaaaaaggccccaaccacaaaccccactccgacatcaacaacaacctcaatttccacgatgacgacgacgacgactatctgtacgaggaattcaaaaccgcccccggatccaacaccaacacgagaagcctcaacaagctctacaagaacaacaacggattcaattcgggtggttcgggctccggatccgggtttcggattcggatcccggccggcgtgccacaacaacaacatacggcgtcgtctaataagattttcaacagccatcttcctcccgggatagtgccacgtggcggaggcgtgaagagggagcgtgagagggacgcggtggcggagatggtggaggcgattaaggtccttcgcgacgggttcgtgaggatggagcagatgaagatggagatggcgagggagatcgagagcatgcggatggagatggagatgaagcgcaccgagatgatcctggactcgcagcagaggattgttgaggcttttgcaatggccgtttcgcagaagaggagcaagggcaagtccacgccctcaccttcatcgcaaccgtag

SEQ ID NO: 4113 - DNA, 1458 bp, Glycine Max
atggtcttgaagggtctatgtgagaggattgtttcttcaaaatgctcttctaaaagctcaaccgagactgtagataatacacaggtgcccgtttattcaaaagcaggatctagtgactgtaagtttcccaaggcttccttatggtcaagcatctttacatctggtttttcagtggttgaaacatatagtgaatcatcagcttctgaaaagaaagcagttccttctcgaagtagtgggtgggcagctgctgtgaggaaagttgttactggtggctcaatgaggagatttcaggagcgtgtactaggatcaagcaggactgacatttcaagttctgatggtgatatatggcttctaggtgtatgtcataaaatttcacagcaagaatctactggaggtgttgatactagtaatggattggcatcatttgaacaagatttttcatcaaaaatcctagttacatatcggaaaggctttgatgctattggagatacaaagtataccagtgatgttaattggggttgtatgcttcgaagcagtcagatgctggttgctcaggcattactttttcataaattaggtagatcatggagaaaacctattgacaagccactggataaagaatatattgacgtcttgcaactttttggtgattcggaggcttctgccttttctatccacaatcttcttcaagccggtaaaggttatggccttgctgttgggtcatgggtgggaccatatgccatgtgtcgcacatgggaagttctagcccgtaagaaaaatgaccttggagaaccgccacttccgatggctatttatgttgtttctggagatgaagacggggagcgtggtggagcaccggttgtctgcattgaagatgcctccaaacgctgctctgagttttcaagtggcttagctgtttggacacctctacttttattggttcctttggttcttggacttgataaagtcaatcctaggtatattccattattgcgctcaacttttaaatttccccaaagccttggcatcatgggcggcaaaccaggtgcttcaacatacattattggtgttcagaatgagaaggcattctaccttgatccccatgatgttcagcaggttgttaatatcagtggggatactcaagagcctactggtacttcatcataccattgcaaggttatgaggcacatacccctagattcaattgatccatccttggctattggattttactgccgagacaaaggtgattttgatgatttctgctcccaagcttccaagcttgcagaagaatcaaatggtgcaccgttgttcactgtagctaagtctcggagtttctcaaagcaagtgagtaatgatgtgtcaggtgacaacactggattccaagaggatgatttccctggcatggactgcggcaatgatacagtaaccaatgaggatgattggcaactcttataa

SEQ ID NO: 4114 - DNA, 1365 bp, Glycine Max
atggtgcactgtgtggtcttagcatatccagctcaaggccacattaaccctatgcataatttctgcaagctcttgcaacaacaaggtgtgaaagtaacactagtcaccaccctttcctacagcaagaacttgcagaacatacctgcttctattgcacttgaaaccatttctgatggttttgacaatcgtggttttgctgagtcaggaaactggaaggcctacttggaacgtttttggcaagtagggccaaagactcttgctgagcttcttgagaaacttggtagatcaggtgaccctgttgattgtgttgtttataattcattcttcccttgggctcttgaggttgcaaagagatttgggatagttggggctgttttcctcactcaaaatatgtccgtcaatagtatataccaccatgtccagcaaggaaatttgtgtgttcccctcacaaaaagtgagatttcccttcctttgttgcccaaacttcaacatgaggacatgcccacattcttcttccccacatgtgtggataattcacttttgcttgatttggtagtgggccagttctccaatatcgacaaggctgattggatcctttgcaattcattctctgagatggaaaaagaggtaaccgattggacgaagaagatatggcccaaatttaggactataggaccaagcataacatctatgattttgaacaagcgacttacagatgatgaagatgatggtgttacacaatttaagagtgaagaatgcataaaatggttagatgataaaccgaaacaatctgttgtttatgtttcttttgggtccgtggtagtactcaacgaagagcaaatagaggaaatagcttatggtttgagtgacagtgaaagttacttcttgtgggtactcagagaagaaactaagcttcccaaagattttgcaaagaagtcagagaagggtttagtaattgggtggtgctcacaactaaaagttttagctcatgaagctatagggtgttttgtaacacattgtggttggaactccacattggaagccttgagtttaggtgttccaatggtcgcaatgccaaattggtctgaccaatgtacaaatgctaagctaattgaagatgtctggaaaatgggaattagagctagagttgatgaaaaaaagattgtgagaggagaagtattgaagtattgcataatggaaataatgaacagtgagaaaggcaaagaggtgaaaagaaatattatgcaatggaaggctttggctgcacgagctgttagtgaggaaggaagttctcataaaaacattgcagaattcgtgaatagcttgttcaatttaaaacagggaattgcaaattatcctgattaa

SEQ ID NO: 4115 - DNA, 342 bp, Glycine Max
atggtgtcattcacgactcttattttcacaagtaataacctagacctatttatcaaattgttccttttattcatctttttctctttcttcattttgcacactttcccttatagtagcaagaccaataatgaggcaacaatttatgaccatgacaccatatgctcaatatacattgaggactacgaggattcggagatgctaaggataatgctgcaatttcgtcattactttcatagagattatgttgacgtgtggttgaagatcaacacgttgtgtctcgtttgtagaaactcgctcgtggaaattagtaataatggtgacacttccttaaattacatctaa

SEQ ID NO: 4116 - DNA, 924 bp, Glycine Max
atggtgtccctcaacctcaacccaaacccacctcaaacttttcacttcttcgaccccttcaacatggaggatcagaataagaaggtccgaaaaccttacaccattaccaagtccagagagaactggaccgaccaggagcatgacaagtttctcgaagctcttcacttattcgaccgtgactggaagaagattgaagcatttgtaggttcaaaaacagttatccagataaggagtcatgcacagaagtatttcatgaaagttcagaagaatggcacaagtgaacatgtacctccccctcgtccaaagagaaaagctgctcatccctacccacaaaaggcatctaaaaatgctcttactatatcccaagttgcgcggccattgcaatcttcatctgctttatctgaatcatcacacatctataggccagattcatcatctgtggttagaactccagttagcagtgtgccattgccatcttgggtttataatgttacaccaccagtcagtcttccccgagtgactaaaggtgatatggtgatgatgagtcaacaaatcaatcctttcagcagtagtaatgagagcactcctaggggttggccaattagcaaacagacagatcagggtgaccaaggcaagccaactataggaatgccagattttgcacaagtctatagcttcattggcactgtatttgatccaaatgcaattaatcatctacagaggctgaaacagatggacccaataaatgtaaaaactgtattgctattgatgagaaacctctccaccaatttaaggagtcctgaatttgagaatgaaggaaggatgctgtcattgtactatgctaacatggagaaggaaaaatccagtagtcatcgaagccaacccctcactgacagatcagagagtgttgtcttatctgcttaa

SEQ ID NO: 4117 - DNA, 768 bp, Glycine Max
atggtgttaatgggaggagttggagtaccctcaatctcaatctgttttttgttccaaacaagacccaccagacatttgtgtctcaaattcagattgaaacattcactttcatattcaatcactagcatggcattgaccaacaacaccaccaccaacgaaaggaagcttccaattctgctgtttgatatcatggacacccttgttcgtgaccctttttaccaagatgtccctgccttcttcggaatgtctctgaaggagctcatagattgcaagcaccccactgcttggattgagtttgaaaagggtctcattgatgaggtggagctagcaagaaaattttttaaggatggaagggattttgatttagaaggccttaaaacttgtatgagaagtggatattcatacatagaaggcatcgaacagttgcttctttccttaaagctaaataactatgagatgcatgcttttacaaattatcctatatggtaccagttgattgaagacaagttaaaactatcaaaatatttgtcgtggacgttttgttcgtgggcttttggtaagaggaagcctgatactgaattctataaggaagttgtcaggcatcttaaagttgatccaacaaattgtattttcgtagatgacaggcaaaaaaatgtggaggcagcaattgaagttggcatcagaggggtacatttccagaatgtcaattcactgtgtgaaaaactgccattgatggggattgacatctcaacaaatgaagatagatag

SEQ ID NO: 4118 - DNA, 1854 bp, Glycine Max
atggttagaacaagaggattaggtcgtgccttagttactagggtcacaggcagaggtagacacgatgagcatcatgcagatgatgttcgccggcgacgtaggccgaccgcatctacccgtaggcaacaggatgtagctccgattactgcagatgtacctgcagcttctgtagagggcttagctgatgctattgctgatgatgttgctgagggatttcctggtgggccacatgacccatcagtgctgacctcgtttggtgaccacgttgcacatcgcatatggatgggagaggaacatcctgacttgaggttggcctcccacggcaggaaggttgagaaaattgggaggccatcacctgagattgaagggctagtcgctgccataggattaagccctttgatcggttgctcaatagtcaccggcaatccgggacttatatctgcgcttgtgaagaggtggcacggggagaccagcagcttccaccttccaatgggagagttgacgatcacactcgatgatgtgtcattactcctccatctgccgatcacagacaccttgcataacttcgagcctctagttgtggaggaggcggtcgtcttgctgatggagttgctcgaggtcttgacaatgcgtgcttatctcctccacttggttggttgcactcttatcgctaacaagagtgcaacacatgttgatgtagtgcatctagaggcttttcgagacctgggtgagagtgggaggttttcttggggagttgcggcgctggtgcatatgcatgaccagttaaatgaagtttctcagaccactacacgacagattgttgggtacattactttattacagtgttggatatatgagcatttttctagtgttcatgacagcgtcattgacgatgcatacgatgagacatccccacgtataaggtcgcacgacagttcgggtacgttcagaccattcctccaccacctgtatcagcagattacatgcagtggattgcaacttacaaagtgtgttggtctcttaccgatcctgcaagttgcaagttgttatggggctgatgtgttagctgctattgaccaagccatagatgatggtgttgatgtcatcaatgtttcttttggtgtcagctacgttgtcactgctgaaggaatattcacagatgaaatttccattggggcattccatgcaatttctaaaaacatacttttagttgcctctgcaggaaatgatggaccaacgcctggaactgttgccaatgtggctccttgcgtcttcacaattgctgctagcacattagacagagatttcagcagcaatttaaccattaataatcagctaattgaggatgcgtttgataaaacactagcagatgcttttgcttacggttcaggacatgttcgacccgatctagcgatagatcctgggcttgtttacgatctaagcctcactgattacttgaacttcttatgtgcttccggatacgaccaacaactcatttccgccctcaatttcaacaggacattcatttgttcaggttctcacagcgtaaatgacttgaactacccttcaatcacattgccaaatcttcgcttaaagcccgtggccattgctcgcacagtcacaaatgttgggccaccaagcacatacactgtaagtacccgctcgccaaatggatatagcattgccgttgtgccaccttccttgactttcacgaaaattggtgaaaggaagacattcaaagtcattgtgcaagcaagcagtgcagctacgcggagaaagtatgaattcggggattttcgttggacagacggaaagcatatagtaaggagttctattacagttaagcgcagatga

SEQ ID NO: 4119 - DNA, 1620 bp, Glycine Max
atggtttcacttggagctacctgtgctctgtgctgttctatgttcatggtgtttgtcactttgagtttggctggggacatagtacaccctgatagtattgctcccagaaggcctggctgtgacaacaactttgtcctggttaaagtccctacttggattgatggtgtggaaagctgtgagtatgttggcgttggtgcaagatttggccctacattagaatcaaaagaaaaacatgctaaccatactagagttgcgatagcggaccctcctgattgttgtagcaagcctaagaataagctcactggcgagatcattttggtgcaccgaggacaatgtagtttcacaaccaaggcaaatatagctgaagaagctggtgcttcagccatcctcattataaattatcgtacagaacttttcaagatggtttgtgaagcgaatgaaactgatgttgatattggaatacctgctgtcatgcttccacaagatgctggtgaaaacttgaaaaatcacatactaaacaattcagtagtgtcggtgcagttgtattctccactgcgtccattggttgatgttgcagaagtgtttttatggcttatggctgtcggtaccattctctgtgcttcttactggtctgcctggactgcaagagagtctgccattgagcaggagaagctattaaaggatgcttcagatgaatacataaatgcagagaatgctggttctagtgcatatgtggaaatcagtactgcagcggcaatatcatttgttgtgattgcttcttgtttcttggttatgctttacaaattaatggcatattggtttgttgaagttctggtggttttattttgcattggtggggttgagggactacaaacttgcttggtggctctgttatcatgtttcaaatggttccagcatgctgcacaaacatttgtgaaagtacctttctttggtgctgtatcatatctgacagttgctgttactcccttctgcattgtgtttgctgtgctttggggagtttatcgccgtgtatcatttgcttggattggtcaagatattcttggcatcacattgataattacagttcttcagattgtgcggataccaaatctcaaggtcggaactgttcttctcagttgtgccttcctatacgacatcttctgggtgtttgtctctaaatggtggttccatgagagtgtgatgatagtggtagctcgaggtgataggagtggagaagatggtatccctatgctactcaagataccacgtatgtttgatccctggggtggttacagcatcattggttttggggacatcatcttaccagggcttctagtagcattttcactaaggtatgattggttggcaaagaagaaccttcgagatgggtacttcttgtgggcaatgactgcttatggtttaggtctccttatcacatacgtggctttgaacttaatggatggacatggtcaaccagctttgctttatatagtcccatttacacttggaacctttttgtcattgggaaagaagagaggtgaactcaaggttttatggacaagaggggaaccaaaaataccttgccctcacatccaagagaatcaatcaacaaaccagtaa

SEQ ID NO: 4120 - DNA, 1038 bp, Glycine Max
atggtttccctttccaccaccccttttcttcccttcactgcaaaaaatgcttctactagaatccctcctcccacatcattctcttacagcaagcaacgtagtaacagggatcccaggaaggttgtctgcgcctgcatcgctcctcctcaaaacttcaagagccaggactcttccgccattcatttcaagggttcgtccaaatcagagcaattgagcactgcgcgggatcatgaggatgattctgatgttcttattgagtgtagagacgtgtacaagtcttttggggaaaagaaaatcttaaatggtgtcagcttcaagatcaagcatggtgaagctgttggaataattggtccctctgggactggcaaatctacagttttgaagattattgcaggacttcttgctccggacaagggggaagtttatattcgaggtaaaaagagagttggtttagtaagcgatgatgacatatctggtcttcggattggattggttttccaaagtgctgcactctttgattctttgactgttcgtgaaaatgttggttttctctggtatgaacactcaagcatgtctgaggatcagatatcagagcttgtcacggaaaccttggctgcagttggattgaagggagttgaggatcggttgccttctgagttatcaggtgggatgaaaaagcgagttgctttagctcgatctattatttgtgacactacaaaggaatcaatagagccagaggtgctcttgtatgacgaaccaactgctggacttgatcccattgcatctactgttgttgaagatctgattcgctctgtgcacataaaaggacaagatgcacgtggaaaacctgggaatatttcatcttatgtggttgttactcaccaacatagtaccattaaaagagccattgatagattgttgtttctacacaagggaaagattgtttgggaaggaatgactcatgaatttacaacttcaactaatccaattgtccagcagtttgcatctgggagccttgatggtcctatcagatattag

SEQ ID NO: 4121 - DNA, 3015 bp, Glycine Max
atggtttctttggcctctgctgccaccacagttactgcagcttcggacagtgaagcaaatgcattgttaaagtggaaatacagccttgacaagccaagccaagatctcttgtcaacatggaaaggttctagtccatgcaaaaaatggcaaggaattcagtgcgataaatccaactctgtctccagaataactcttgcagattatgaactgaaaggtacacttcaaaccttcaacttctccgctttccctaacctcctcagcctaaatatattcaacaactccttttatgggaccattccaccacaaattggtaacatgtccaaagtaaatattttgaatctttctacaaatcatttccgtggttctatccctcaagaaatggggagactaaggagtttacataagcttgatctttccatatgtctattaagtggagctattcctaataccataacaaacttgtccaacttggaatatctagatttcggtagcaacaatttttctagccacattcctccagagattggaaagttgaacaagttggagtatctaggctttggggatagtcaccttatcggttccattcctcaagaaattggaatgttgacaaatcttcaatttattgatttgtcaagaaactctatctctggtactatacctgaaacaatagaaaacttgatcaatttagagtatcttcaacttgatggcaaccacctttctggatccattccttccaccattggaaacttgacaaatctcatcgagttgtatttaggactcaacaatctttctggatcaattcctccctctatagggaacttgatcaatttggatgtccttagtctccaaggaaacaatctttcaggaactattcctgccacaattggaaatatgaaaatgctcaccgttttagaattgaccaccaacaaacttcatggcagcattccacaaggcttgaataacattaccaactggttttccttcttaatagctgagaatgatttcacaggccatttaccacctcaaatttgctctgctgggtatctaatctatttaaatgctgatcacaaccatttcacgggtccagtgccaagaagcctaaagaattgcccgagtattcataaaatcaggctggatggcaaccaattggaaggagatatagcacaagattttggtgtatatccaaatttggattacattgatttgagcgacaacaagctatacggccaaatttcaccaaactgggggaagtgccacaatcttaatacattgaagatatccaacaataatatttctggtggtataccaatagaacttgttgaggcaaccaagctaggtgtccttcacctttcttctaaccacttgaatggaaaacttccaaaggaattagggaatatgaaatcattaattcaactcaagattagcaacaacaatatttctggaaacattcctacagaaattggatcactgcaaaatcttgaagaattggatcttggagataatcagctgagtggcacaataccgatagaagttgtgaaattacccaagttatggtatttgaatttgagcaataatagaataaatggaagcattccctttgagtttcaccaatttcagcctcttgaatctcttgatcttagcgggaatttgttgagtggaacaataccaagaccacttggagacttgaagaaactgcgcttgttgaatctctctcgcaataatctttctggaagtattccctccagttttgatggcatgtcaggtttaacttcggtgaacatatcatacaaccagttagaagggccacttcctaaaaatcaaacctttcttaaggctccaattgagtcgttgaaaaataacaaggacttgtgtggcaacgtcactggcttgatgctttgcccaaccaaccgcaatcaaaagaggcacaagggcattctattggttttatttattatcctgggtgctcttacactagtattgtgtggggtgggagtttcaatgtacattctttgtttgaaaggtagcaagaaagcaacccgtgctaaagaatcagaaaaggcactgtctgaagaagtgttttccatatggagtcatgatggaaaagttatgtttgaaaatatcattgaagctaccgataacttcaatgacaaatacctcattggagttggagggcaagggagtgtttacaaggctgagttgtcttcagatcaggtttatgcggtgaagaagcttcatgtggaagcagatggagagcagcacaatcttaaagcttttgaaaatgaaattcaagctttgaccgaaatcaggcaccgtaacattataaagctctgtggatattgcaaacatacacggttctcatttttggtttataagttcttagaagggggtagcttggatcaaatactaagcaatgacacaaaagcagctgcatttgactgggaaaagagggtgaatgttgttaaaggtgtggccaatgctttatcctatatgcatcatgattgctcacctccaattattcatcgagacatatcaagcaagaatattcttttggattcacaatatgaagcccatgtctctgattttgggacagctaagattctcaagcctgattcacacacttggaccacgtttgcagtcacctatgggtacgcagctccagagcttgcccagactacggaagtgacagagaaatgtgatgtattcagttttggagttctttgtctagaaatcatcatggggaagcatccaggagatctcatgtcttcattgttatcttcatcttcagcaacaataacttataatttgttactaattgatgtgctagaccaaaggcctcctcaacctctaaactcaattgttggggatgtcattttggttgcaagcttggcattttcttgcataagtgaaaatccaagttctcgcccaaccatggatcaagtgtctaaaaagcttatgatggggaaaccacctttagcagaccagttccctatgattagacttggacaactcctctaa

SEQ ID NO: 4122 - DNA, 732 bp, Glycine Max
atgtataaatattttaaatatgtgacttgtgagggttggattgtaagaacaggtgttgtggtgaggagtgttgttttttgggttgctggttttttcagcaacatcgaggctgggaaggactttgtggatgttctgtctagcttcttaacgtttcctttaggaaacattgccatacaaatggaaaaggagtcaattgaagttggatccctgagctcactttatccaagtgtgacaaatattgacaaagtgtgtctgtccaaagaaatgctactgcaactcaggaactcattggaagcttatatggataatctgaaggtgaacattgatgacattttgctcagaccaggaatatgttggctaaaccaatttttcccatcaatgaaagctctaattaatatcacttttattatcacggacgatttgaatgtcgtgtcagattctttggatactattttttatcttctgaagaattatggaatagaagatgtgtctttaatgaatgaaatgccttttatcttttcatttataattctgcaactaccaaccattaaagcaaagcaaaacaacttaaagttcattactgaccaggcaatagagggaaacgttgtttctcacgttatttcaccattttgtcacccaacatcatgttacaacaaacacatttcattcattttcacaacattcacgtactcaagaatcaaaacacaatgtcatcaagtcaatcaatattga

SEQ ID NO: 4123 - DNA, 741 bp, Glycine Max
atgtcaatcacaacaggaatatgtcaagtagttgctgtttcattgcttttgggattactgagtgtgtattccttggaatgtgatgatgatcgctgcaaaactgggctgtgcaacaacactggtgcctgcatttgcaacctccctgatccttccaccatcttgaatggtgatagaactttcttcggggggaagttttgtgacgaagaaatgaccatgtgtgatgggacaaactccttctggtgtgaacatggggcaacttgtgaggagattgttcaaggagagaagtactcttgcaaatgtcccctaggatttgctggggagcattgtgagcattctggagcaccctgtggtcatactttttgtttccataatgctgaatgcttggctgaaacaggtgatgtttgccagtgcccttctgaatggaaaggcagtgctgattgctctcttccaaccacaccaacaggtttttactcaatttcaactgacacaaaatcatctaaagtcagcagcagcagtgactccaatgaggcactggctgtcttggcagtttcttcagtgggaggagctgctgctggtgccatttatggcaagaaactattcaacaagaaaaaaagagaggcaaggttccagcaattatctgaaatgcagactcaagggatattggatggtgatggtgatgaggaggatgaaaaccacaatatggtaccccaaagggtccatggtgatatttcacacaattag

SEQ ID NO: 4124 - DNA, 1470 bp, Glycine Max
atgtcaatcttcgacggagctttcatgaacacgcaactctccaagcacacttcgatcttcggcctccgtctctgggtcgtgatcggaattctcatcggagtcttcatcgtcttcacgctcttcctcctctccctctgccttgtctctcgccggaaccgccgccgctccggcgcaggcaccggctacaaggtcgccggaggcgccgacgcggcgaaggacatccacacgatcgtgcaccttcccgggccccacatgctccggcctccggcgccggagatccacgtggagatggggaagaagacggagcaccgggtggtggtgcagtgcgatagggtttcaagtgaggagagtaaggtcacggtggggagtgggtgtgaaacgacgtcgtcttttggaagtgggagtgttggtgggcctgggcctgggcttgggcctgaggtttcacatcttgggtgggggaggtggtacactctgagggagcttgaggatgccactggagggttgagtcctgaaaatgtggttggtgaaggtggctatggcattgtctatcatggggtactcaatgatggtaccaaaattgctgtcaagaacctcttgaataacaagggacaagctgagaaagaatttaaagtagaggtagaagcaattggtcgagtgcgacacaaaaatcttgttaggttgcttggatactgtgtcgagggagcctacaggatgcttgtgtatgagtatgtagacaatggcaatctagaacaatggctgcatggggatgttggagctgtaagccctttgacatggaacatacggatgaacattatattgggaacagcaagagggttggcctatcttcatgagggtcttgaaccaaaagttgtccaccgagatgtgaaatcaagtaacatactcattgatcgccaatggaactccaaggtttctgattttgggcttgctaagcttttatgttctgagaatagttatgtcacaactcgagtgatgggaacatttgggtatgttgcaccagaatatgcatgcaccggaatgctaactgagaagagtgatatttatagctttgggatacttatcatggagataattaccggaagaagccctgttgattatagtagaccacaaggagaggttaatttaatagaatggttgaagactatggttgggaatcgaaaatctgaggaagtagttgatcctaagctccctgagatgccatcttcaaaggctcttaaacgcgctttgttgattgctcttcggtgtgttgatcctgatgcaaccaagaggccaaaaatgggacatgtgatccacatgcttgaagcagatgacctgttattccatactgaacaaagaactgagggagagtcttcccgttcctatcaaagtgagcaaagggactcaaatttagataagagaagagatggaggtgccaatgataaaagtgaagatgctagtactagatggagatga

SEQ ID NO: 4125 - DNA, 231 bp, Glycine Max
atgtcaattacagatttctttgctattactatatctactgtggtgtcaataggactaaaatcccaacgtccctattcagatgtttcttttagcaaatcaagctttctctctgatataaaaatcatggtaggatcgagaaacctctacaccccgatgatatctcaattcttggaagaatatattcttaaattctctgcaagcagatctttgacccatccgccccagttataa

SEQ ID NO: 4126 - DNA, 963 bp, Glycine Max
atgtcagaaattgacatggcggttattaaacctgagatgatgaagccttatatctggcttgagacatcagatggttcaatccaacaagtggaacaagaaattgcaatgtattgccctctgatttgtcaagaaataatacaaaaaggcatgggatcttccaagagttgtgcgatatgtcttcctcaacgagtcagtcctgtgacgttgagcttaattcttgattattgtcgttttcatcaagtaccaggtcgctcaaacaaggaacgaaagtcttatgatgagaaattcattaggatggacacaaagcggctatgtgagttgacatctgctgcagacagccttcagttgaagccattggttgatcttacaagtcgtgcacttgctcggataattgaaggaaaatctccagaggagatacgtgagatatttcatctgcctgatgatcttactgaggaagagaagttggagcccttgaaaaacacaactgatgacccaaggatcaggcttttgaatagattgtatgccaaaaagaggaaagaactaagagagcgtgagaggttaaaggatgttgaagttgaagaagagcatgtagatgagcgttcagttgatgaccttttgtcttttattaatggaaatgatggaggtccaaaggaagttaaaacttctaagaataaaaagaaaaatagaaggaaaaaagagcaacaacagaagaactcttctctgaaggaagcttctgaagtgaacaaggttgttgaagtaaatggtcaaagtatcagacaccaaagtgctgaagctgatagaattgctgagacctcaaattcacatacagaagatgtatttgctcatagagaatttgatgatggagatatagatgatgggattgatcctgcgctaaaggaaaaaattgacaggttgggctacattctaaatgcatgtttggtaatgctttttcaggagaaataa

SEQ ID NO: 4127 - DNA, 2862 bp, Glycine Max
atgtccaaactaaatgttttgaatttttctttaaatcttttccgtggttccatccctcaagaaatgtggacactaaggagtttacgcggccttgatctttcccaatgtagtcaactaagtggagagattcctaactccatatcaaacttgtccaacctgtcatatcttgatttaagtatctgcaatttttctggccacattcctccagagattggaaagttgaacatgttggagattctacgtattgcagagaataaccttttcggttccattcctcaagaaattggaatgttgacaaatcttaaggatattgatttgtcattgaacttactctctggtactctccctgaaacaattggtaatatgagtaccttgaatctgcttcgtctttccaataactcctttttatctgggccaattccatcctccatatggaacatgactaacttgacattgctctaccttgataacaacaacctttctggatcaatccctgcttccataaaaaaattggccaatttacagcaacttgcacttgattacaaccacctttcgggatcaattccttccaccattggaaatttgacaaagctcatcgagttgtatttacgctttaacaatctttctggatcaattcctccctccataggaaatttgatccatttggatgcccttagtctccaaggaaacaatctctccggaacaattcctgccacaattggaaatttaaaaaggctcaccattttagaattgtccaccaacaaacttaatggcagcataccacaagtcttgaataacattcgcaactggtctgccttgttactagctgagaatgatttcacaggccatttaccacctcgagtttgctctgctgggacactagtgtactttaatgcttttggcaaccgtttcacgggttccgtgccaaaaagcttaaagaattgctctagtattgaaagaatcaggctggaaggaaaccaattggaaggagatatagcacaagattttggtgtatatccaaagttgaaatacattgatttgagcgacaacaagttttacggccaaatttcgccaaactggggtaagtgccctaatcttcagaccttgaagatatctggtaataatatttctggtggtataccaatagaacttggtgaggcaaccaacctaggcgtgcttcacctttcttctaaccacttgaatgggaagcttccaaagcaattaggcaatatgaaatccttaattgaactccagcttagcaacaaccatctttctggaaccattccaacgaaaattggatcactgcaaaagcttgaagatttggatcttggagataaccagttgagtggaacaattccaatagaagtcgtggaattacccaagttacggaatttgaatttgagcaataataaaataaatggaagtgttccctttgagtttcgccaatttcagcctcttgaatctcttgatctaagtgggaatttgttgagtggaacaataccaagacagcttggagaggtgatgcgactggaattgttgaatctgtctcgcaataatctttctggaggtattccatcaagttttgatggcatgtcaagtttgatttctgtcaacatatcatacaaccagttggaagggccacttccaaataatgaagcctttcttaaggctccaattgaatcattgaaaaataacaaaggcttgtgtggcaacatcactggcttgatgctttgcccaaccatcaacagcaacaaaaaaaggcacaagggcattctactggcattatttattatcttgggcgctcttgttctggtattatgtggagtgggagtttcaatgtatattcttttttggaaagcaagcaagaaagaaacccatgctaaagaaaaacatcaatcagaaaaagctctgtctgaagaagtgttttccatatggagtcatgatggcaaaattatgtttgaaaacatcattgaagctactgatagcttcaatgacaagtatcttattggagttggagggcaaggaaatgtttacaaggctgagttgtcttcagatcaggtttatgcggtgaagaaacttcatgtggaaaccgatggagagaggcataattttaaagcatttgaaaatgaaattcaagccttgaccgaaatcaggcaccgtaacattataaagctatatggattttgctcacattcacggttctcatttttggtctataagttcttggaagggggtagcttggatcaagtactaagcaatgacacaaaagcagttgcatttgactgggaaaagagggtgaatactgttaaaggtgtggccaatgctttatcttatatgcatcatgattgctcacctccaataattcatcgtgatatttctagcaagaatgttcttttggattcacaatatgaagcccatgtctctgattttgggacagctaaaattctaaagcccggttcacacaattggacaacgtttgctggcacgtttgggtatgcagcaccagagcttgcccagactatggaagtgaccgagaaatgtgatgtatttagttttggagtgctttctcttgaaatcatcacggggaagcatccaggagatctcatttcttcattgttttcttcgtcttcatcagcaacaatgacttttaatttgctactgattgatgtgttagaccaaagactacctcaacctctaaaatcagttgtcggggatgtcattttggttgcaagcttggcattttcttgcataagtgaaaatcctagttctcgcccaaccatggatcaggtgtctaaaaagctgatggggaaatcacctttagcagaacagttccctacgattagatttggacaactcttctag

SEQ ID NO: 4128 - DNA, 549 bp, Glycine Max
atgtcccctaaagaactggttacgcttgcagtcccatttttaaacagtgatgataaagaaagtgcaattcctttactaagactagcccttgataaggaccctgactatgtacgagctttagttttgatgggacgggttctattgctgaaacatgtaaatgatgaagctaatgagtactttgagcgtgcaatatcaaagctttctcttgctggacattcagctgatgcggaagaagttgatcttttgattctttcatcccagtgggctggaattgcctgcgaacggcagggaaagagggccgaaggacgggcacactttgaaagagtagcaaatatgcaggagccagaagatcctactagcaaaggctattattttgatgggttactgttgcttgccagcactctatttgatgcaggtcaaaaggccgaagctgcgaagtacctacgtcttgttgttgcttataaacctggttataaaaaattcttggaacagtgtgaaaaagatgatgattttacaagtgatcttgcccgtagtaggagagacctctaa

SEQ ID NO: 4129 - DNA, 780 bp, Glycine Max
atgtcgcccaacaacgtggaatctgggacaacggatgatacagaggtagtaggacaacaacaacgtcatagtccaatacatgatattgccttgcagatacagacacaggctccggtggaaacccatgggctataccaaacaaatgatgttcatacgcgtccgatgggcatggccgtgatagacgcgatcctcccaccacaaaatccttctagcttaatgagcttcaaggaagctgtagtgtcaaatgcaaggagaattccccttaagaccctagttactttgctccttgtttgtgttggtatcatggatcatcttgcaaaagagttgagcattcaattccttttggaattaataaactcccatgctgcaacacaagcaccgcttagcctaggcgaggcatttcaagggtttcgtactgtgattgcatatgagatggcaatcatgctggtctttctgctggctttgttgcttagttgtccacaaccattatgtgggatggttatggtgacaatctcctttcttggactattcgtccacattccagatctggtgggcaaggcaccagggattgctgtgactagcggtttcttcaggatgcctctcatttgctttacaaccatagtggcttttgttcttacgctggtttttgttttccttgcggtgttctttgcttatcttacctatggatgcgcacgtggtgcggggatatcaacagggggagaacttgaggttgccatgcaagattcgctggggaatgtggaagaggggggggtgaactga

SEQ ID NO: 4130 - DNA, 519 bp, Glycine Max
atgtcgtggtgttactgcgctaagcctatgactttgcagttgccgttgcaatcaagagcagcatcatcgttccattcccacgttggaggagtaacagtaacattctcaacactgtctcttcgaccctcttctcctcttgttctgacccacaacctccacttccaacccaaactcaaacgcgcttccacaaccattcgctgctcctctgggttgactcctcaattgaagtctaccttggatcaagttattgcttcaaataaagtagttgtgtttatgaagggaactaaagactttccacagtgtggattctcaaacacagtggtgcaaatattgaagtctctaaatgtgccttttgaaaccataaatgtgcttgaaaatgacttgttgcgccaagggctgaaagagtactccagttggcctacctttcctcaagtctacatagaaggagagttttttggtggctgtgatatcactgttggtaccccatctttcatctgtttacattgctgttataattga

SEQ ID NO: 4131 - DNA, 2007 bp, Glycine Max
atgtctactatttctggtatgccgcttttctttctttgttgcttcttcggaccaagttatgaatactccaaatactgtaataacagtaatggaaactacacagccaatagcatctaccaaaccaacctcaataccctcttatccaccctcacttcccacacagaaatcgactatggtttctacaatttctcgcatggccaaaactcagacaaagtatacgcaatagggttatgcagaggagatgttaagccagacgaatgtcgcagctgcctcaacaattctagagtgagtctcacacggttgtgtccaaagcagttcgaggcaatcaagtgggaagagaagtgcatgttgcgctactccaaccgcgcaatttttcacaccatggatgcttctttttcgtatcctatgagcaacataaacaatgcaacggatgcggaagagttcaataaagtgttgggtgagttacttagaaatctgagtgacaaagctgcatcaggtgactctcggcgcaagtatgccgcggatactgcagtctttgcgaatctccaaaccatatacggtcttgtgcagtgtacgcctgatttgtcaaggcaagactgcggtgactgcttgcattggagtttggcagatttcggaaatgttttcaaaaacaaagttggtgctgtagtgcttagaccaagttgtaatgttagatatgaaatctaccccttctacgatgaacctacaccatcagcatcgaagattctggtttttgcagaaaagggcaactcactgcgaactacaatcgccataattgtgcctaccgttctcgttgttgttgctttgctcattttcattagcatatattttaggaggaggaaattagcaaggaaaaatcttctcgctggtaggtctaagtattatttgattcatcaatactttctattttcaaccaagtcctattatgaaattgaattggctgaatcattgcaattcaacttggacacaataaaagttgcaacaaataacttctctgactctaataaactcggagaaggtgggtttggagctgtttaccagggcaggctctctaatggacaagtgattgctgtcaaaaggttgtcaagcgattctggccaaggtggcgtggaatttaagaatgaagtccttttactggccaagcttcagcaccgaaatttagttaggctacttggttttagtttggaagggaaagaaaagctacttgtttatgaatttgttccaaataaaagccttgattacttcatatttgatccaacaaagaaagcacgactggattgggatagacgatacaaaatcattcgaggtattgctcgaggtcttctttatcttcacgaggattcacgattgcgcattatacatcgtgatctcaaagcaagcaatgttctcttagatgaagagatgattcctaaaatatcagattttggtatggcaagactgattgttgcaggtcaaacacaagaaaatacaagtcgagttgttggaacctatggatatatggcaccagaatatataatgcatggacaattttcaataaaatcagatgtcttcagttttggtgtactagttcttgagattgtaagtggccaaaaaaaccatggtattcgtcatggggagaatgtggaagatctactaaactttgcatggagaagctggcaagaggggacagttacaaatattatagatccaatattaaacaatagttcacagaatgaaatgataagatgcacccacattggtttactctgtgttcaagaaaatctagccaacagaccaaccatggctaacgttgcactcatgctaaatagttgttctatcactctcccagtgcctacaaaacctgctttttttatggatagtgcaactacaagccttccaaacatgtcatgggaagttaattcagggacaacacgatcgaatcagtccacaaccaaatcagctcacgactcattaagtgaggcttcaatttctgagctataccctcgttag

SEQ ID NO: 4132 - DNA, 1044 bp, Glycine Max
atgtctcaagcagttatcaacgaaaatgaagtggacattgtgattggtgcactgcactctgatcttacaacttttatgaatgaatggaagccaattttctcccgttttcacctgataataataaaagatcctgatctcaaggaggaactccgaattcctgaagggttcagtgtggatgtgtatacaaagtctgagattgagcgagtggtgggttcttccacttctgttcgcttctctggctactcttgtagatattttggcttcctaatttcacggaaaaagtatgttgtctgcattgatgatgattgtgttcctgcaaaagataatttagggatactggtggatgctgtggctcagcatattgtgaaccttcagactcctgccacccctttcttctttaatactctgtatgatccattctgtaagggtgcagattttgttcgcgggtacccattcagcctgcgaagtggggttgattgtgctctgtcatgtgggttatggctcaatctggccgaccttgatgctccaacacaagctctcaagcctggacagaggaatttgcgatatgttgatgcagttgtgactgttccttcgagagccatggtgcctgtgagtggaatcaacattgcctttaaccgtgaagttgttggtccagcattagtcccagctttgaggcttgcaggggaagggaaattgaggtgggaaactatggaagatatatggtgtggaatgtgtgtgaaagttatatgtgatcacctaggtcttggtgtgaaaagtgggttaccttatgtttggagaacagaaaggggtgatgcgatacaaagcttgaagaaagaatgggaaggggtgaaattgatggaggatgttgttcctttctttcagtcattaaggttacctcaatcagcaactacagcagaggattgcgtggtcgagatggccaaaacagtgaaggagcaactggggaaggttgatcctatgttttcggcggctgctgaagccatggaagagtgggtcaagctctggaagtcagttagatctgtttga

SEQ ID NO: 4133 - DNA, 528 bp, Glycine Max
atgtctcctattcaacttggcagagggaagaattggctaagatactttcagtatgaagaagaaagggacacaccaagtgacacaagaaacattcttctgataatcttcactttggttgcagcagtgacatttcaagctggggtgaatcctcctggtggagtttggcaagaaaccaatggtgaacacattgcaggaagagcaatatatgcatcagacaaacaagcttactatgtcttcctcatcttcaatactttggcattttctaattccatcttggtcattctctcgctcactcacaagttccctttccatttcgagatatgtgttgccactatttccatggctgtgacttatggatcatccatttttgctgtctccccagacgattctgtaagatttcgctatatccttatcactgctgcggggccttttgtttttagatttctggttcttatcttcaacttgctcttaaggaaacatgttcaaagtcagaatctactacctgaatcagactcagttcgtggttga

SEQ ID NO: 4134 - DNA, 435 bp, Glycine Max
atgtcttccccaagcaagcgccgagagatggacttgatgaaactgatgatgagtgattacaaggtggagatgattaatgatggaatgcaagaattttatgtgcaatttcatggacccaatgacagtccttatcatggtggtgtgtggaaagtaagagttgagttgccggatgcttatccttacaaatctccttccattggctttatcaacaagatctatcacccaaatgttgatgagatgtcaggatcagtttgtctggatgttatcaatcaaacctggagtcccatgtttggtcttgttaatgtgtttgaggtgtttctacctcaacttctgctgtatcccaatccatcagaccccttgaatggagaagctgcagctttaatgatgcgtgatcgaccaagttatgaacaaagggttaaaggtcttatctgctga

SEQ ID NO: 4135 - DNA, 1026 bp, Glycine Max
atgtcttcgtctattcccaattccaaattcaagaaattttttaaacttgacatatctgctatcaccttttccgtttcttgcgattcgacgatggccgatcaaaagctttcagaaccggcgcttaaacgtgagcagcttgatgaattcgtgagtagtctatattttgaacaacgaattcttgaactccgacttcttcaagacctcgagaacaatgatgaatgtaggaaaaatgggagcctgaaaaggttaaatgaccagagtgatgtctgtggatttagaagttgcttcaaaaatcattatgattcgcttccgaatcagaggtgcttgaggaatcgagaagaagtgattcaggagacgatggaaatggagttggaaaatatgatggaactgggcaccctcaagggcaagaaaacatattcttttaagaatggtacaagaagtgcgttgaaccttgagaacaccacaagatcctttctagataacaataaatcaaatgataataactggaatggcgaaatgactttacccctgctagtagacaagtccaccgtctgtatgttaaacaaggatgaggaagtagacgagcccctcagtccgggcaaacacatgaaaactgcacaaagtgttttatcacttttgatagcgactattgcgcttctttggattctcaccgacctatgcagcctgttatcaattatcaagcttcagccagaacatggccccctccccattcggttttctttgcttgaacctgttggtttcatggtgtttgtttgggctgttgcagcaatgattgttattggtgcaccattttctcgtttggtgagtgccattcttttattttggggtatttggctgcttgtcagatcttctcaatcactcactacactatgccttccaatattgggaatccttctgatggtgtggcatctctgctcaaggaaaagcagctgccaaataaagggtaatgaacaaggaagtgaagctcccaaaattaaaccaatgcgtttcactcttgctgtctaa

SEQ ID NO: 4136 - DNA, 2238 bp, Glycine Max
atgtgtggaatatttgcgtatctgaattacaacctcaacagagagagacaatacatcttgcaggttctcttcaatggcttgaggagattggagtaccgcggatacgattccgcaggcatcgcaatcgacgattcctcttcttctcaattctctctttcgcctcctcctctggttttccgtcaggaaggaaacatcgaatcgctcgtcaaatccgtctatcaagaagtgggagaaactgaactgaacttgggggaatgcttcggcacgcacgcgggaatcgcgcacactcgctgggcgactcacggagagcctgcgccgcggaacagtcaccctcagagctctggtcatgggaacgagttcttggttgttcacaatggagtcatcactaattacgaggttttgaaggagacgctgcttagacatggcttcacctttgaatctgaaactgacaccgaggtcatccccaagcttgccaagtttgtccacgacaaggcgaatgaagcgtccggaggtcaggttgttaccttcagtcaagttgttcttgaagttatgaggcatcttgaaggagcttatgcccttattttcaaaagtccacattatcctaatgaattgattgcctgcaagcgtggtagcccactgctgctaggtgttaaactttgggtggtctgcaaacgtccaaggctccaacaaatagtttgtattaatcctatcactgcagtccaaatgacaggaaacaggaaagttttccacaagaaactggaaacaggacctactgcaattcactcgagttatctaagttctaccaaatccttcaattcggcaatgaatggggaaagtcatagacagaaaaataaagaacatggttcagcatttgaggataacaaattcctatcaaaagatggaaagcccagagaattgtttttgtccagtgatgccaatgctgtggttgagcatacaaagaaagtgctagttattgaggatggtgaagtagttcatctcaaggatggtggggtttctattttgaaatttgagaatgacatgggagaacatggtgcttctctttccagagctttctccgtgcgacgtgcattatctgttcttgagatggaggttgagcaaataaataaaggtaattatgagcattacatgcaaaaggaaattcatgagcagccagagtctctaacaaccacaatgagggggaggcttatacatcgaggatctaacaaatccaagtctgttctgctgggagggctgaaggatcacctcaaaacaattaggcgaagtagaaggatacttttcattggttgtggtacaagttataatgctgctttggcagctagacccatattggaagaactttcaggtgttcctgttactatggaaattgctagtgatctattggatcgagagggaccaatataccgggaggatactgccgtttttgttagtcaatctggtgaaactgcagacactttacttgcactgcaatatgctttagacaatggtgcattgtgtgttgggataacaaacactgttggtagtgcaatagcaaggaatacacattgtggtgttcatataaatgctggggctgagattggtgtggcaagtaccaaggcatacacaagtcaaatagtagtgatggtcatgttagctcttgcaataggaggcgatacaatttcaaatcaagccagaagagaagctatcatagatggtctttttgatctgccagataaagtcagagaggtgctgaagcttgatctggagatgaaggatctagcaaagcagttgattgctgagcagtctcttcttgtctttgggagaggatacaactatgcaactgctcttgagggagctttgaaagtaaaggaagtggctctaatgcatagtgaagggatacttgctggtgagatgaagcatggtcctttggcattagtggatgaaaatctcccaattgttgttttagctacccgtgatgcctgcttcagcaaacagcagtctgttattcagcaacttaatgcccgcagaggtcgtctgatagttatgtgttcaaaaggggatgcttcctctgtatgccctaatgaatcttgtagggtaattgaagttccactagttgaggactgtcttcaacctgtaattaatgtagttccattacagttattggcatatcatctcactgttctcaggggacataacgtcgaccagcctcgtaatcttgccaagagtgtcacaacgcaataa

SEQ ID NO: 4137 - DNA, 171 bp, Glycine Max
atgtgtttatcatttgacaatgtgaaactcacagatcagttgcaactccttggtatcaaggtcacatctgattctgatctcctggcacctcagcttgcagaatttcttgcaattgtcagtttggcaataattatggcttgccgccttgcatttcagatctgtgaaaagtga

SEQ ID NO: 4138 - DNA, 312 bp, Glycine Max
atgtgtttcttgaacttgagaaactttttgctgaatagcttggacttccctttgcagtttgcatggcttcaactttatccaaccaatcattcacttcattcagacgcccagggtgatgtgcctcagccacttcaaccccacactcacatcaacccaaacgccttgcaggtcagatgttatgtctctcaaacaagaaaggttctcttcaaactcgaggatgcaggcaaagagtcccacatgcgaattatgaggtccaacactggacctatgaaatccatcaaggctagattgaacttaggaaaagaaaagtga

SEQ ID NO: 4139 - DNA, 237 bp, Glycine Max
atgttaaggggcaaattgaagaatggaagcccagaagacgggtccggaaaagagttattactgactccaccaccactaccaccaccgccagcagatgattgcccttgttgcatctgcatagattcctcttcatccaagggcaacctctcatatgctacattagtaaaagatgaagcaataacaataacaggcccagaagccaccaaaggaccaacaacatttcctcccaccacttga

SEQ ID NO: 4140 - DNA, 858 bp, Glycine Max
atgttaatgtttggaccagatttatgtggcacggatacaaagaagctccatgtgatactctcctaccacggtcaaaattaccccataaagaaggacctgcaatgtgaaactgacaggttaactcatttctacacattcattctcaggccagatgccacatacagtgtcctggttgataatagagagagagattctggaagcatgtatacagattgggatattcttcctccacgaaaaatcaaagatgtcaaggccaaaaaggctgcagactgggaggaaagagaatacattgaagaccctgatgatgtcaaacctgagggatatgattcaatcccaagagaaattcctgacccaaatgctaaagaggctgaaaactgggatgaagaggaagatgggaaatggaaaccaccaaagataccaaatccagcatacaaaggaccatggaaaagaaaggaaatcaagaaccctaactacaaagggaaatggaaaactccatggatagataatccagggtttgaagacgaccctgatctttatgtgcttaagcctatcaagtatgtaggcattgaagtttggcaggttaaaggcggttcagtttttgacaacgttttgatttgtgacgaccctgattatgcaaaacaagttgttgaggaggtgtttgccaacagggaggttgaaaaggaaggttttgaggaagcagagaaagtgagaaaagccaaagaggaggaggctcaaagagcaagagaagaaggtgaaaggcgtagacgagagagaggtcatgatcgacgatatcgggacagatatagagacaaatatagaagggatcgctatgattacgatggtcatgacgagctttga

SEQ ID NO: 4141 - DNA, 2373 bp, Glycine Max
atgttcaaattcctgaaagaggtcgttggcggatctggcaccggcgtcaaggatctcccttacaccatcgctgaatcttacccttctgcttggggctcttggactcattctcgcggcacctccaaggatgacggttctcctgtctcggtgttctcactctccggctccaatgctcaggatggtcacttagctgctgcacgcaatggtgtcaagcgtcttcgaactgtcaggcatccgaatatcttgtcgtttcttcacagcactgagattgagacgtatgatgcaggttctcctaaggttacaatatatattgtgaccgagcctgtgatgccactatctgagaagatcaaggagttagggcttgaaggtacacaaagggatgaatattatgctttgggtcttcatcaaatagctaaagctgtgagcttcttgaataatgattgtaaacttgttcatggcaacgtttgcatggctagtgtcgttgtgacaccaactttggactggaagcttcatgcttttgatgttctatcagagtttgatgggagcagtgaaatgtcttctggccaaatgctgcaatatgcatggcttgttggatcacaatacaaaccaatggagttggcaaaatcagactgggatgcaattaagaagtctcctccatgggccatagattcttggggcatgggttgcctaatctatgaggtattctctggattgaggttgggcaaaacagaggagttacgcaacattggttccattccgaagtctctgcttccagattaccaacgactattgagttccatgccctctcgtagattaaatacatcaaagcttatagaaaacagcgaatattttcaaaataagttggtagacacgatacatttcatggaaattctcagtttgaaagatagtgtagagagagacaccttcttccgcaagcttccaaatttagctgagcaacttcctcgccagatagtgttgaagaagttacttcctttattagcttctgcccttgaatttggttcagctgctgcctcagctttgactgcattgttgaaaatgggttcctggctttcagctgaggagtttaatgtcaaggtacttccaacaattgtaaaactctttgcctccaatgatcgagctatacgagttgcccttcttcaacatattgatcaatatggagagtctttatcagcgcaagctgttgatgaacaagtttaccctcatgttgctactgggttctccgatacatctgcttttctcagggaactgactcttaagtctatgttaattctggctccaaagttgtctcaaaggacaatgtcagggtcattattgaagtatctgtcaaagttgcaggttgatgaagagccagcaattagaacaaatactaccatattattaggcaatattggaagttacttaaacgaaggaacaagaaaaagagttttgattaatgcatttacagtccgtgcattacgtgatacttttccacctgctagaggagcaggcattatggctttatgcgccaccagttcctactatgacatcactgaagttgcaacccggattcttcctaatgttgttgtgctcacaattgatcctgacagtgatgttagaactaaggcatttcaagctgttgatcagtttttgcagatagcaaagcaacattatgaaaagacaaatgcagcagataccactggtgttgcaggtgtgggaagctcatctgttcccggaaatgctagtttgcttgggtgggctatgagttctttgaccttgaagggtaaaccttctgatcatgctccagttgcttctgcaagttcaactgcaattacttcaacatcttctaatggcaccgcaggtatagagacgccatcaacagcaccagcccgtgtaaactctacctcagatttggctgaacaccctgtgcctacgtctcctacatcaacggatggctggggggaacttgagaatggaattgatgaggagcatggaagtgacagggatgggtgggatgatctggaaccacttgaagagtcaaagccagctcttgcaaacattcaagcagctcaaaggcggcctgtttctcaacctatttcacatacaaaacaaggctcgaatttgctatcaaaaagtacaccaaaattgaacaaggatgaggatgatgatttgtggggatctatagctgctcctgctccaaaaactgcaagacctttaaatttgaaatcagctcaaactgatgatgatgatccttgggctgccattgctgctccagcacccacgaccaaggccaaacccttatcgactggcagaggtaggggagccaaacctgctgctccaaaattaggtgctcagcggataaaccggacatcataa

SEQ ID NO: 4142 - DNA, 990 bp, Glycine Max
atgttcgtcaatagtatatactaccatgtacagcaagggaagttgcgtgttcccctcacaaaaaatgagatttcccttcctttgttgcccaaacttcaacttgaagacatgccctcattcctctcctccactgatggggagaatttagttttgctcgatttggcagtggctcagttctccaatgtcgacaaggctgattggatcctttgcaattcattctacgagttggaaaaagaggtaaataattggacattgaagatttggcctaaatttaggactataggaccatgcataacatctatggttttaaacaagcgacttacagatgataatgatgaagatgatggtgttacacaatttaagagtgaagaatgcatgaaatggttagatgataaaccaaaacaatctgttgtttatgtttcttttgggtccatcgcagcactcaacgaagagcaaataaaggaaatagcttatagtttgagagatggtgaaaattactttttgtgggtggtgagggcctcagaagaaactaagcttcccaaagattttgaaaagatatcagagaagggtttagtgataaggtggtgctcgcaactaaaagtcctagaccatgaggctatagggtgttttgtaacacattgtggttggaactccacattggaagccttgagtttaggagttccagtggttgcaatgccatattggtctgaccaaagtacaaatgcaaagcaaattgtagatgtctggaaaatgggaatcagagccacagttgacgatgagaaaaaaattgtgagaagagaagtattaaagcgctgcataatggaaataatgaagagtgagagaggcaaagaggtgaaaagcaatatggtgcaatggaaggctttggctgcacgagctgttagtgaggaaggaagttctcataaaaacattgcagaattcgtgaatagcttgttcaatttacaacagagaattgcaaattatcctgattaa

SEQ ID NO: 4143 - DNA, 960 bp, Glycine Max
atgttgatcgtgttcatttgcatcttccttttcttcatctttctttacaagttcctcatcgcttatggcgatttcactttgatgtctaagaagcaacctaagcgccaagagattgaagataaggttgtttggattactggtgctagccgtggaattggggagattctggctaaacagtttgcaagtttaggggccaagcttattatctctgcaaggaatgaagctgagctaaaccgagtaaggacacagctgaaaggtaagcatgcacctgatgacgtcaagatcttaccattggatttatcatctggagaggattctcttaggatagctgttgagaaagcagaatccttttttccggattctggtgttgattacatggtccataatgcagcttttgagcgtccgaaaacatcaattttagatgtaactgaggaaggtcttaaggctacctttgatgtcaatgttctggggacaataactctcacaaagctcttggcacctttcatgttgaagagggggcatggtcattttgtggtgatgagtagtgcagcaggaaagacacctgccccaggtcaggctgtatactctgcttctaaatatgcgctcaatggttacttccataccttgcgttcagagctttgtcagaaaggaatccaggtaactgtggtctgtcctggtccaatagaaacatcaaataatgctggatcaagggttccatctgagaagcgtgtgccatctgaaaggtgtgcagagctgactattattgctgcaactcatggcttaaaggaagcttggatatcatatcagcctgtgcttgctgtcatgtatctcgttcagtacatgccaactattggttattgggtcatggacaagattggcaaaagtcgagtagaagctgctgaacagaagggaaacacatattctttgagcttactgctcggaaaaaagaaggccacttga

SEQ ID NO: 4144 - DNA, 3462 bp, Glycine Max
atgttttactcacagtttattttggccaagaaagggccacttgggactatatggatagctgcgcatttggagaggaagctccggaagaaccaggtggcagataccgacattggcgtctccgtagattccattcttttccctgaagtaccaattgcactccgtttgtccagccatcttctacttggtgtggtgaggatatattctagaaaggtgaattacctttttgatgactgcagtgaagccttgcttaagattaagcaagcttttcgttccacagcagttgatttgccacctgaagagtccactgcaccttaccattccatcaccttacctgagacttttgatcttgatgattttgaactaccagataatgacattcttcaaggtaactatgttgatcaccatgtcagtactagggagcagattacactgcaagattctatggagggtgtggtttacactacttcacagtttggcttggatgagcgctttggtgacggtgatgcttctcaaattgggttagaccttgatgaggtaatttgtctttttattttttggaagtataaattgatatattcatctgagatttacaggcctggtatgcctgatataaatctgtcatttgcatcatttcttcatcaaaatgatgaaaagaaaccggagattgatgatttacccactgctgctgaagtcagtaaatatgctgaaggtccatcaacccctggactggaagagccaaatttatttggaactcagatggatcagggcaataatgaacaaaaaagagaagcaggagcatttagcatgcctggttactaccctaccaccctgttaccagaatgtgaaggtgggatgatcaatgcttctgatgtagctgagaaggaggaggacttacaagatggagttttggcaaacaataacctagtttctgctcctttggcaaattttgttgtttctgctcctttgatgaacaatgaaaaagttgcttctccttctcatagtgaggggcaatcctgtctgtttgacgatgctccagtatccaatgttatcagtcctctaggatcacctggtagacctgaagttgttgatgaggaagctcaggcctctcaagaactgaaggaagcagagactttaaaccatgatcttactatccttgttaagatcctttgttttaagatcttgcaaccccctcccaatcctaagctggatcttgatcttgataacattgtctgttactataaatttataatacaattttgtatttttttcctttggataagaaaagtatttatcaagaaagaaaaggaactacagggtcttctaaatacagattttagcatttctttccgactaaatacaccaaggaactgcagcctgagaacactgccaaagctttttggcatctttcctattaccaaatcctctgatcatactgggtcttctaaagaaacacctaattcagggaaaactgatatgcaacttgagagtcagatatttagtaataaagtagaaagtattaacagatctgctgctactgacatgccagagcctgaaaagttgctctcagcttaccaacatgatggtgaagcaaatgatttgctgatggcatctactcctgacaatcagggtgcaactgaaggccatacaggtgctgcaggagaaaaatacatctccggtaaaaaacgtagctacacagaaagtactcttacagtgcagagtatggatttgattgaatcttacacgggagctcaatccaagagaactgctgagtctgttcccgatgatgatgatctactgtcatctatattagttggtagaaagtcttcagtcttgaaaatgaagcccagtcctgcagcccctgaaatagcatcaatgaagcgtgttcgttctgcttctgcaccacgtactagtgccttaaagaggaaggtgcatatggatgatatgatggtcttgcatggcgatacaatacgccaacaattgacaaatacggaagacattcgtcgcatacggaaaaaagctccttgcactcgtcatgagattttaatgattcaaagacaatttttggaggatgaaattttccatgaaccaatatttatggatttgtctactgatttgactattctgcgaaatgagacatttgatctgactggaatcaaggttattgagtatggtttagatagttcttctgtagaaaaaacaaatgatcaagagtcctattctagaacacatactgaaattcatggagtggagggtaataatgaacctatggcagtccaactccaagaagatgcagaagtgcaacctactgaggtacctgttttgtctgagagtcatcagtctaaggttaacttgggatctcatgatattgatgctcatgggcacacgagtattatttctcatgtggaggagcttgacagttctcaaaatgttgaattgaacaatctcagagcaaatattgcagtttctgaagctgagaattgctctgttggccctgggcatgaatcttcatccttaactgaagtcttcgaaaatgattttgctgcatcactggctctcatggataaaaccaatgatctcgttgattctatccattcaaatatattgagcattccaaatgctgagaatttgaatacaatccctattctagaggatgactttgtggaggatcaaagtgatagaaatggagtaggtgctattaagtgtagcatggaaactggaacacaagttcaaacagatggtgtggatgccaatgatttatatacatccttggccactggttctacagaaactgatgaatttactaatattcaggcttcctttaatggtgacctaccattggaggaaaatggaaacagcttgctagggcagttaaatgaggatcaaattgttgcttctggcatggattgtgatgacaaggatgcaaggcctgactgcatatttattgaaaatgctaaagtagattgcttacaatctgaagcacttggattagatgaaaaagagagtttgttgaaagatgaagaaatccctgtctgtcaggaagctgaactacaaagtacaatgtgccctgaaattaggagtcctttagtagatcagaatgatgaaaatgacatgattgctaatgacacagggtttttgaatgttggtgatgatgagataattggggatgatgatgattatcaatcatgtgctgaaggaactaaccttgaaaatagcggatggtcttccagaaccagggctgttgccaattatctgcagactgtgtttgataaggaagatctacatggaagaaaggagttgcatcttaacaatttattagttggtaaaacacggaaggaagcatctcggatgttttttgaaactctggttctcaagacaagggattatgtccatgtagaacagacaaaaccctttgccaatgttagcataaaacctcgaatgaagcttatgaagtcagatttctga

SEQ ID NO: 4145 - DNA, 1056 bp, Glycine Max
atgttttataagcacagtgtaaatggcaatgattgcaatgatggaaaggaaggaaatgagtcacctaagtttttgctgaatcttattgacactcctggacatgttgattttagttatgaagtgtcgaggtcactggcagcttgtcaggctgatggatctgattttgaagctctaaatcatgcaatagagaggctgacatgcaatgatgccagtgtctctattactaaagaaactagcactgctctaggtctggggttcaggtgtgggtttttaggccttctgcacatggatgtttttcatcaacggcttgaacaggagtatggagctcatgttatatcaactgttcctactgtgccttatgtatttgagtttcatgatggaagcaagttagaagttcagaatcccgcttcattaccctctaatcccaagcataaagtgacagcctgttgggaacctacagtgttagctactataatcattcctagtgaatatgtgggacctgttattacccttgtctctgagcgtaggggtcagcaattggagtactcattcattgacagtcaacgggtattcatgaagtactgcctgcctttgagagaaattgttgttgacttttataatgaattgaagagtataacatcaggctatgcatcatttgattatgaggactcagattatcaacaagctgatatggtgaaactggatattctcttgaacggacaaccagttgatgcaatggctaccatagttcataacacgaaagcatatcgtgttgggcgtgaactgacagagaaattgaagggcgtcttagacaggcaaatgtttgaggtaaacatacaagctgccattgggtcaaaaatcatagcaagagacctaagcttctgtttaaagatttccgctatgaggaaaaatgtccttgctaagtgttatggtggtgatgtttctcgaaaaaggaagttattggagaagcaaaaggaaggaaagaagagaatgaagcgtgttggttccgtcgatgtaccacaagaagcatttcacgaattattgaaggtttcttag

SEQ ID NO: 4146 - DNA, 792 bp, Glycine Max
attcgcggcccaatggcggaggaaccggagagcaccgtcaccaacggcgccgccgacgaatcgctgctcgataagatcaccgagaagcttcacggccacgattcttcgtcctcttcatcttccgactccgactccgactccgaaaaaaccgttacttcctccgttaaggataaggtttttcgcctcttcggaagggagagacccgttcactccgttttcggcgccggaaaacctgctgatgtgttattgtggaggaacaagaaaatttctgctggcatgcttggcggagccactgctgtttgggttctttttgagttgcttgagtatcaccttcttactctggtgtgtcacattttgatactgttgctcgcagttctgttcttgtggtccaatgcccatactttcatccacaaatctccacctcgcattccggaatttcatcttccagaggagccattcctgcaagttgcgtctgcattgagaattgaagtcaaccggggatttgctgttttgcatagtattggctctggaagggacttgaagaaattcctagtggttattgctagcgtatggattctgtcaattgtggggaactggtgcaatttcttgaccctgttctacataacttttatcttgttgcacacggttcctgtgctatatgagaagtacgatgataagatagatccacttgcagagaaggcagttattgagattaaaaagcagtatgctgtgtttgatgctaaggtcttgagtaagatcccattgggtccattgaaagccaagttatcttag

SEQ ID NO: 4147 - DNA, 1620 bp, Glycine Max
atttctgataaaaatttgatctttttttatgattggggttataggccatatctcccaccgttggctctttcttcacgctgccacttctcagccatgaaggatcaatgctcacaactgaacaagggaatgtggatgtgtcaaccgcatttgatgcatgtttctagtcatttccactcagtaaagggagaaaatagagagagccacctacttgctcaagttcagccaccattagatttttcatgccaagcagatttttcaaaaggccattctgtgaaaaatagtgaagtgaattcgtacaatgatatgaaaatggtaaatgatgcgattgttaatgccaataatgttgagatgccaatgtctggctctgaggaagtaagtgatgaaagcgctatgctgaaaaatgctatcaatggtgaggatttcggagggcaacctgcttcagaaggagaacagaaagaggtatcccatgcaacgggagcagttaaaggtagtgagtatcccagaagctattataaatgcacacagcctaattgtcaggtcaagaaaaaggtggaacgatcccatgacggtcaaataacggaaattatttacaagggtgctcataaccatgcacaaccacaccccggacatcgagcatcttcactttctactgatgaggtttcagacatggctgaagacagtaccttagctaaaattgaaggtgggtatgtctggagaaatattcaaacaggattaaaagatacaaaacaaagttttgattggaaggctgatggacaggaaaggacatcatcaacttctgctgtgactgagctttcagatcctatatcaactaacaaagctaaatctctacgtatatttgaattggaggacactccagagctttcttctacacttgccagtcatgatgatgatgaagatgggaccgctcacgcacttgtgtcggctgaagacgaagctgagaatgatgaattggaaccgaaaataaggaagaaagagagctatgcagttgaaccaaatttgccccctactagggctgttcgagagccaagagtggttgtccaaattgagagtgatgtggacatacttgatgatggttaccgctggcgtaagtatggacaaaaggttgtcaaaggaaatccaaatcctaggagctactacaaatgtacaagtactggatgtatggtaaggaaacatgtggaaagggcttcacacaatctgaaatatgtccttactacttatgagggaaagcataaccatgaagtgcccactgctagaaccaacaatcaggtaaactcaagtgatggtggtttacctcccaatggtgctaatggacaagtttctcttacattaccagggaatgctggcattccaaagcccgaaactcatcaaactcttggacatcattttgatagaaaaccggaattcagcgacgagtttctcaggcctagtttggttggaagtttcgggaatgatatgaagtttcggccttcttccctttgccaaatgaattctatgactgttgtttcaatttgttggttttgtggaggaaattataaaaaacagaggagagaagagacacaatacataaggaatcacttattgactaggctaatccattaa

SEQ ID NO: 4148 - DNA, 1031 bp, Glycine Max
caataccaaggaatcaaccaatgggatggtttgctagaccctctcgacgacaacctacgcatggaaatcctaagatacggccaattcgtcgaatccacctatcgcgcattcgacttcgacaccaattctcccacttacgccacatgtcgctacccgaaaacatcgctactcgctcgaaccggaccgagaaaatccggttaccgagtaacgaagaacttacatgcaacatgtggggtagaattacccaactgggtttcctctttgtctcagctgccacgtgttcaatctagttggattggttacgtggcggtatgcgaagacagggaggaaatcgcacgtctggggagacgcgatgtggtaattgctctaaggggaactgccacgtgtctggagtggttggagaatcttcgtgtaaccttgacgaaattgcccagccatatgggctgtggatacgaagactgcatggtggaaaacggttttttgagtctctatgtctccaaaacgggcgcgtgtccgagtttgcaagacatggttcgcgaagaggtggcgagagtgatcgaatcatacggcgatgagccactcagcataactataaccgggcacagccttggagccgcactcgcgattctcagcgcgtacgatataaccgccacgttgaagaacgcgccgatggtcactgtggtttccttcggtgcgccccgcgtgggcaacgaaaagttcaggagtcagttggagaagagtgggacccgcatactaagaatcgtaaactccgatgatgtcatcacaaaagttcctggactcgtggttcgagatgatgacgtggcgtgcagtggcggtgtccacgcggcgggattgcagagttggttccgtaaggttgttgatgacatgcagcttgtgtacgctgacgttggacaagagttgagagtgagtagcagggaatcgcagtatctgaagaaaggagatgtcgccacgtgtcatgatctcaagacgtatcttcatctggtgaatggttttgttagttcctcgtgtcc

SEQ ID NO: 4149 - DNA, 828 bp, Glycine Max
cagagtgcacaccgagcaactaccatggctaccgctccttcgcttctacactcatctgggtcctcttttttctctcaatttcgtgcctttcaattctcttcttcttcgctgtttcctcatggaaacaggcatgggaatgccgtggtctctgtgaaggcctctgcttctggggttgtgttggtggagaagtctgaggcagagaaggccaataggctcaaaacagcttacactgagaaaattattcccttgctcatggaagagttctcttacaccaacaaacaccaggtgcctaaaattgagaagattgtggtgaactgtggtattggagatgctgcgcaaaatgcaaagggtttggacgcggcaataagtgatctagcactgatcacagggcagagacctattaagactcgggccagggcttctcttgccacttttaagatcagggaaggtcaaccgcttgggattgctgtgacactaagaggaaatatgatgtattcattcctagaccgagttatcaacctgggacttcctaggacaagagatttccaaggtgtgaaccccaacagctttgatgggcatgggaactacagcattggcattaaggaccagggtgtgttcccagagatcagagccgatgttgttggtaagcctcggggaatggatatctgcatcgtgacgacggctaataccgaccaagaagcacagaaattgttagctcttatgggtatgcccttcagagagggaagtggtcctgccacgacaattcggaaaaagaagcttaagtctcatcattttgatgcaaaatcaaagggaagaggaaggaggtga

SEQ ID NO: 4150 - DNA, 1995 bp, Glycine Max
cagatatctccaggtgtttggtacattggtcttttcaatggcattggacctacaaggacgcagtcaaagatgattatccgtggtccatcattttccttcattgctaatataagtgtggaagcatgcacaaattcaatgatgaggggggatttctgtaacagttcagtttatccactttcatgtgcagaatctgatgtctctaatgctttggaagctaaaatgaacaagtcaatgttggaaagtttggtgacctgcaaaagtaattttgaagctttttgtgttcatgaaggcatgccaaacttcttctccctggatattatgaatgtggcagaagaaattatcattacggcagcaaatatcagattcaatgttagtcgatcaaatgatattagtttaatgtgttttgtccgccatggtgcaatgccttctgtgacttcgaatgattataacattaatattgctaaaggcccactggttattcattcaccattaattggccgttggtacattagtatagtgccagtcaatcttacaaagactcaggataacagtgtaagagtttgctattcagtggaatctcaagtgcttcaatgcccacttgggaaagctggaccaaattgtacaatggatagctacttgcttcagacatttgtaaggagaggttcaaccccctttgagtcatattatttaccagttgttggaggagcatcgtatgattctgccaatttccctctcgagccacttttagacgactcatcatacagtggagaacctgataacatttggacttactttcttctgaacattcctcgtggtgcagctggaggaaatattcacatacagctatcctcagatatgaagatcagttatgaagtgtatgctagatttggtggattaccatctcttgatagctgggactattattatgctaacaagacaaggaggagtgatccatctatgtttttcacactatatgactcaagtgataacaaagttaatttttatattatgtatgctagagaaggaacttggggtattggtctaagacatcttaataccagcagtgattccatgaaagggcttactatcatgtctatttcacttgagcgatgcccaaaacgatgctcctctcatggagaatgtaaattttcttttgatgctagtggattgacatcgtacagcttctgctcttgtgatcgaaaccatggaggcttcgactgtagcattgagattgtaacacatcaaggacatgtacggcaatcaatttttctcattgtatcaaatgctgcagccatacttcctgcctactgggcccttcggaagaaggtggcattagcagaatgggttttatacacatccagtgggatttcaagtggactatatcatgcgtgtgatgtaggaacctggtgtgcattgaactataatgtcttacagttcatggacttctggctctctttcatggctgtgattagcactttcctttatctagctaccattgatgaagtacttaagagagcaatccacacagctgttgctatccttactgccctaatggctgcaacaaaagcaaccaggtcttccaatgttattcttgtaattgtgattggtgctcttggtttgtttattggatggttgatagaaatctcaacaaagtataggtccctttccttttcaattggaatctcatttaatttctctcactgtttccaaactataaagcagtggctctataatcttgtcaagacacttttgagacggtaccactgggcatttgccttggctggttttcttgcattggccatggcagcaataagctggacacttgaaaccagtgaaacctactggttttggcatagcatttggcatattacaatatacacatcttctttcttcttcctttgttcaaaagcaaatattgaggatactgagaatcagcttcctacaaatggaaactatgaattgactcatcaggattcacttccaagaactggttag

SEQ ID NO: 4151 - DNA, 1044 bp, Glycine Max
catgcaaactgcaaagggaagtccaagctattcagcaaaaagtttctcaagttcaagaaacacatagatgtttgggaaattcatgaactaattgataaagggcattttgatgtagtggctcaggaagtgccacatgctttggtagatgaaatacctctagaggccacagtaggtctagaatcaacctttgatgaacttagtggatgttttgatgacaatcatgttggagaaagacaacccagctcaaaaagttcaataatgagttccttcccacaaaattctatgatgttagcatttgggctgtggtgtctagaaaagcacgtaatcaaggatgtctacgaaggtcttttagctgaatttggtgatgatgtctacgaagcacgtaatcaaggagaagaaatcatagcaagcttgaagcttacttgtttgttggaggacagagagagagaaaacaggattaagatgcatgatatgatcagagacatggctttgtggctagcatgtgatcatggatccaacaccaggtttttggtgaaagatgatgcatgcagcagttcaatagtatcactctggggacctagcattcaaatcctctcaggaaaatcagattgctcaaatctctcgactatgattgtcagaaattctgagctaacagacctttctgatgagatctttctgactgcaaacactcttggagtgttagacttgtcagggaataaaagagtaaaagaattacatgcgattattggggagttagttagcttgcagcatttggatctatcaggtactggtatacaagaattgccaagggagctccagaacttgaaaaagttgagctccttagaatataattgtccctcattggaagaagtcataggtgaagaatttggacatgcagaaaatgttttttccaaaaccctaaggcaatcgaattacctatcgttgttgtgccattccaatttcaatttcaacccattaacgaatagaataacccgtgaacgcttttctgtgacgcgtgcactgctgtgttcccagacacgctaa

SEQ ID NO: 4152 - DNA, 345 bp, Glycine Max
ccagcaaccgctgaaggcaccacacaaggagctagtgaaacagtcaataacagtttgaacgaagcgcaagacaaggcttacaccacagcggaacatgtggctaacaagacaaatgaggtggctggtcagatgtcagcaagtgctcaaaatatggctggtaaagcaaagcagacaatgcaagaggcatgggaattcagtaagaacaaagccaataccgtggtaggaaagactaaagaatcagctgaacacgccaaagataatgtggtaggaaagactaaagaatcagctgaatacgtcaaagataatgcagaggcagtgaagaagaacatgaactcaaagaactga

SEQ ID NO: 4153 - DNA, 561 bp, Glycine Max
cctagtgcaccaaataattgcataaacttcacactgttactaaattttggcctcctttctgttagtgttaacggagttcagaacattatagcaagggttccgtgctttttcttgtggatgattagcataaggaagatgtcactggatggtcaccctggttttgattgtggcggtgctttatggttccagaatttaacagaactctctcatggttattcagggttcatcttcccttttctgattgctggtttgcactacgtcactgttcagggatataaccttaaaaatatagtgctacttatcttttgttgtcttacccccatattcatgttcacgtgcattaaactggcaaagttgatggatccaaaagcaattgatcatagtttgatgtatagttggatggatttcctgcttttgtttgggatttgtttagcttatgctattgggcaaggactagccagtcatagaatgtgtactaattcgtatttattgatttatcagatatcctttaggaaacctttggttgcagaaacacgggatatttttgacttattagccaaa

SEQ ID NO: 4154 - DNA, 807 bp, Glycine Max
gaatgggagaagctaaagatattgggagagggttcttatggaaccgtctccctagctgtgcttactgccccggaagaagcaaaaggagagctaatagctgtcaagacttcaaagcctcacggtttagattcattgcagaaagaagaaaccatattagattcattctttggctgcaaagaaattctccgatgcatttggagcctattcaccatggagaatggtcgttttgtctacaatctcctcatggagtttgccccttgcggttctctgggagacttgatcagaaagaaaccactctcggagagccaagtgagagtatactcacgcatgcttctcaaagggctttctctcgttcatcgattcggggtcgttcattgcgatttgaaaccagacaacattcttctctttccttcgggcgaggagaatgatgtggattatcaactcaagatcgcggatttcggactttcaaggaccaaagacgaggtgtttgatgcagacttttggaagatcaagttcagaggctccccattttacatgtcaccggaatccgtcatgggccgaatcgaaacaccattggatatatggtctcttgggtgcatggtaatcgagatgatgaccgggtttccagcatggaaccacattcctaccacaagggacttgatgttcaaacttgcattcctcaaagaagcaccaccgttgccttctgggctgagttctctttgccaagatttcttgaacaagtgtttcgtcaaggattctgctcagagatggacggccaacatgcttctcgaccatccttttatttct

SEQ ID NO: 4155 - DNA, 333 bp, Glycine Max
gacaaggtctctgtactgcgtgaagctgtgaactatgtgaaacaacttcaagaacgtgtgaaagagctagaaaatcaaatgaggaaggaatgtgtgaattcaataatacttaccaagaaagcgctaatttgcaaaaatgatcgtgtggaagaactcctcgaggtgaaagtaactgtgttagataaggaagtgctcattggagtccattgtgagaaacaaagaaaatctttgctcaaaatattgtccttgcttaataatctccatctttctataaccagtaccagcgtattgccatttgggagttccactcttaagattaccattatctctcag

SEQ ID NO: 4156 - DNA, 1401 bp, Glycine Max
gagaccacagagctccaccatgctcctgagggtcttgttgacacaaatggaggagactacactgaaatgagtggctttgcagatttcaaaaacgtgttctctgtggaatctataaagctttggacaattgctgctcccattgccttcagcatactatgcaattatgctgtcaattccttcacgactatctttgttggtcatcttggagatttagaactctcttcagtttcactctctctctctgtcgtttcaaatttctcttttggcttcttgcttggtatggcaagtgcactagagactttatgtgggcaagcatttggtgctggacaagtagaaatgataggggtctacatgcaacgttcttggttaatcttattgggtgcatgcatctgcctcacaccaatttacatttatgctgagccaatcttgctactcctaggacaagaacccgaaattgcagaattagctggggcatttaccattcaatccatccctcagatgttttctctagccatcaatttccccactcaaaagttcttgcaggcacaaaccaaagtggggtttctggcatggcttggttttggagcatttatttttcatgttatacttctatggattttacttaaagtgttttcattgggtacaactggtgctgctgtagcctattgcacaacagcttggattattgctttggctcaaacggcttatgtgattggttggtgcaaggatgggtggagaggcttctcatggttagcattcaaagatctttgggcctttgtgaaattgtctgttgcttcagcagtcatgctttgcctagagatttggtatttcatgatcttgattgtgctcactggacaccttgacaatgcagttattgctgttggttctctttcaatatgcatgactatcaatggatttgaaggcatgttatttatagggatcaatgcagcaattagtgtgagggtttcaaatgagcttggatcaggacgcccaagagcagcaaaatattcagtcattgtcacaattattgagtccctcatcattgggttaattagtgcagccattattttagctacaaaagatcattttgccatcattttcactgagagtaaagagatgataaaagcagtttctaaattagcaggtcttcttggcataaccatgattctgaatagtgttcagccagttatatcaggtgttgctgtaggaggagggtggcaagctttggtagcttacatcaatctattttgctattacatcatggggctccctcttggcttccttttaggttacaagttgggttacagagtggagggtatttgggttggaatgatctgtgggacaatgttgcaaacgctcatcttgttgtacattgtctataaaacaaactggaacaaggag

SEQ ID NO: 4157 - DNA, 399 bp, Glycine Max
gctgtggaggtccttgtattcctgatacctatatatagatttatttatgattgtgttttgttgttgtttgtggcatttgcaaggattgtaaaccactgttttgtaagcaagggattcttcccctctaattcattcctgtgggacagacttgataaaatgaggcatatcaacaacacaaacgtgcagtcagcctgggatcttcatagagcttggccagaggcagattttaggagttctcattatttcttaacggatcagactagttttcgcttatcaagcctatgtggttccagagatgcagggcattcagccaatgaaccagccataactgctgaactcgtggctacaaatgagaaattgaaaaacataaccaagaacaaaggggagtgcactgaatag

SEQ ID NO: 4158 - DNA, 495 bp, Glycine Max
ggacctcttccttttgttcttgaaaccgagtatgtgggggttggtgaatcagagaatgtgcaggccttctactattcaattgagtcagagaacaatcccaaagaggatcctctcatgctatggcttactgtggccctggttgctcatggttttctcgcattgtccttgaaattgttagaagagtgtatttcgaacatttttctttacttttttgccatactgtgtacctatgtagtaggtccagttgcatttaatcatgagcaatataatgggagccttcccactttgatcttgaggccacaatcatggacaaaggtaattgattttaacttgtgccattatatttgtaggcttgcctttagtttgaaactggatgatttgtatgtaacaatgatggctgttgagttaatttcacaggctgtttttattttttgtttatttaacttatcttattatgtgttatttatgtgtataatggttgatgaagatgcacag

SEQ ID NO: 4159 - DNA, 129 bp, Glycine Max
gtgaagaagagggttgaacgactctcagaggattgtcgtatggtgataaccacctatgaaggtagacacaatcactccccttgcgacgactcaaattcatccgagaatgaatgctttacctctttctag

SEQ ID NO: 4160 - DNA, 426 bp, Glycine Max
gtggtatccgcgcatattctcatttcaatttgcatttgcatttcatttggcgttttgtttctttctggaagcttcacttcggcatccatggcgtcgttcgaagaagctcctcccggaaactccaagaacggcgagaagatcttcaagaccaagtgcgctcagtgccacaccgtggacaaaggtgccggtcacaaacaaggacccaatctgaatggtttgtttggaaggcaatctggcacaactcctggatattcctattctactgctaacaaaaacatggctgtgatttgggaggaaaagaccttgtatgattacttgctcaaccccaaaaagtatattccagggacaaagatggtgtttcccggtcttaagaaacctcaggaacgtgcagatcttattgcatatcttaaagaatccactgcataa

SEQ ID NO: 4161 - DNA, 1947 bp, Glycine Max
gtttggcctgaatcccaaagcttcagtgataaaggatacggtaccgtcccatcaaaatggcgcggaggcctttgtcaaattaacaaacttccaggttccatgaaaaatacatgcaacagaaagctgattggagcaagatactataacaaagctttcgaggcacataacggccaactggatccattgctacatacagcacgtgactttgtggggcatggaacccatactctatcaactgcagggggaaattttgtcccaggagcgagggtatttgccgttggcaatggcactgcaaagggtgggtcaccaagagctagggttgcagcttacaaagtgtgttggtctcttactgatcctgcaagttgttatggggctgatgtgttagctgctattgaccaagccatagatgatggtgttgatgtcatcaatgtttcttttggtgtcagctacgttgtcactgctgaaggaatattcacagatgagatttccattggggcattccatgcaatttctaaaaacatacttttagttgcctctgcaggaaatgatggaccaacgcctggaactgttgccaatgtggctccttgggtcttcacaattgctgctagcacattagacagagatttcagcagcaatttaaccattaataatcagctaattgagggagccagtctttttgtaaatctgccacccaatcaggccttttctctgatcctctccactgatgccaaacttgctaatgcgacatttcgagatgctcaactttgtaggcgtggaacacttgatcgtacaaaagtaaacggcaaaatagtgttatgcactcgtgaaggaaaaataaaatcagttgctgagggtctggaagctctaaccgcgggcgcaaggggaatgattttgaacaatcagatgcaaaatggaaaaacactttctgctgagcctcatgttttttccactgtgaacacgcctccaagacgtgcaaagtcaaggccccatgatgtgttccatattttatacatgcatgtatgttatataaatttattttgcagtggggacgaggatgaccctttaaaaacgggtgatacaataaaaatgtcccgagcaagaacgttatttggaagaaagccagctccagttatggcatcattttcatctagaggacccaataagattcagccatcaatactcaagcctgatgtaactgcgcctggtgtgaacattcttgctgcctattcagagtttgcaagtgcatctagcttgctagtagacaatcgtcgtgggtttaaattcaatgtattgcaaggaacttctatgtcttgtcctcatgcttcgggcattgctggacttctcaaaacacgacatcctagttggagtcctgctgctattaaatcagctatcatgaccacagcaaccacactcgacaacactaataggccaatccaggatgcgtttgataaaacactagcagatgcttttgcttatggttctggacatgttcgacccgatctagcgatagaacctgggcttgtttacgatctaagcctcactgattacttgaacttcttatgtgcttccggatacgaccaacaactcatttccgccctcaatttcaacaggacattcatttgttcaggttctcacagcgtaaatgacttgaactacccttcaatcacattgccaaatcttcgcttaaaacccgtaaccattgctcgcacagtcacaaatgttgggccaccaagcacatacactgtaagtacccgctcgccaaatggatatagcattgccgttgtgccaccttccttgactttcacgaaaattggtgaaaggaagacattcaaagtcattgtgcaagcaagcagtgcagctacgcggagaaagtatgaattcggggatttgcgttggacagacggaaagcatatagtaaggagtcctattacagttaagcgcagatga

SEQ ID NO: 4162 - DNA, 111 bp, Glycine Max
tcccacatgatgggggtatatatgagatggagggtctcacacataagtgaagattgttgggaatgtcaagcgagtaagaagtcctacactggatgtgaatgggtaggttaa

SEQ ID NO: 4163 - DNA, 2289 bp, Glycine Max
tgttacattgtatacttgggagctcattctcatggtcctagccctacctctcttgacctcgaaatcgcttcccattctcattatgatttactagcttcagtcttgggaagtgaggagaaagcgaaagaagcaattatttactcatataataaacacatcaatggcttggctgcgctacttgaggaggaagaagcagcagatattgcaaaaaacccaaatgtggtgtctgtgttcttgagcaaagaacataaactgctcacaactcggtcttgggaatttcttggactagacagtaataataaggactctgcatggcaaaaggggagatttggtgaaaatacaataattggtaacatcgacacaggtgtttggcctgaatccgagagcttcagtgataatggatttggctccgtcccatcaaaatggcgagggggtaacgtttgtcaaattaacaaactccctggctccaagagaaatccatgcaacaggaagctgattggagcaagattctttaacaaagctttcgaggcagccaatgggcaacttgatccatctaacgaaacagcacgtgattttgtggggcatggaacccatactctatcaactgcagggggaaattttgtcccaggagcgagtgtatttgccgttggcaatggcactgcaaagggtgggtcaccaagagctagggttgcagcttacaaagtgtgttggtctcttactgattctggaaattgttacggggctgatgtgttagctgctattgaccaagccatagatgatggcgttgatatcatcaatctttctgctggcggaggctacgttgtgagtccagaaggaggaaaatttacagatgaggtttccattggggcattacatgcaattgctagaaacatacttttagttgcctctgcagggaatgatggacccacacctggaactgttctcaatgtggctccttgggtcttcacaattgctgctagcacattagacagagactttagcagtaatttaaccatcaacaataggcagcaaattacgggagccagtcttttcgtaactttgccacccaatcaaaccttttctctgatccttgcgactgatgctaagcttgctaatgcgacatgtggagatgctgcattttgcaagcctggaacacttgatcctgaaaaagtaaaagggaaaatagtgcgttgtagtagagatggaaaaataacatccgttgccgagggtcaggaagctctatctaatggcgccgtggcaatgcttttgggcaatcaaaatcaaaatgggagaacccttcttgcagagcctcatgttttgtctactgtgaccgacagtgaaggcattcaaatcacaacgccacccagatcgcagaaccctactggggacgaggacgacatccctatagaaacgggtgctacaataagaatgtccccagcaagaacattatttggaataaagccagctccagttatggcttcattttcatctagaggacccaataagattcaaccatcaatactcaagcccgatgtgactgcgcctggtgtgaacatacttgctgcctattcagaattggcaagtgcatcgaacttgctagtagacaatcgtcgagggtttaaattcaatgtattacaaggaacttctgtgtcttgtcctcatgtcgctggtattgctggacttatcaaaacacttcatcctaattggagtcctgcagctattaaatcagcgatcatgaccacagcaaccacacttgacaacacaaataggccaatacaggatgcgtttgatgataaagtggcagatgcctttgcatatggttcaggacatgtgcaaccggaacttgcgatagatccgggacttgtttatgatctatgcctcgatgattacttgaactttttgtgtgcttccggatacgaccaacaactcatctccgcactcaatttcaatgtcacattcatttgtaaagggtgtgacagcgtaacagacttgaactacccttcaatcacattaccaaatcttggcctaaaacccttaaccattactcgcacagtcacaaatgttggaccaccagccacatacactgcaaatgtcaactcgcctgctggatataccattgtcgttgtgccaagatccttgaccttcacgaaaattggtgaaaagaagaaattccaagttattgtgcaggcaagcagtgtaactacgcggggaaagtatgaattcggggatttgcgttggacagatggaaagcatatagtaaggagtcctattacagttaagcgcagatga

SEQ ID NO: 4164 - DNA, 777 bp, Glycine Max
tgttatggggctgatgtgttagctgctattgaccaagccatagatgatggtgttgatgtcatcaatgtttcttttggtgtcagctacgttgtcactgctgaaggaatattcacagatgaaatttccattggggcattccatgcaatttctaaaaacatacttttagttgcctctgcaggaaatgatggaccaacgcctggaactgttgccaatgtggctccttgcgtcttcacaattgctgctagcacattagacagagatttcagcagcaatttaaccattaataatcagctaattgaggatgcgtttgataaaacactagcagatgcttttgcttacggttcaggacatgttcgacccgatctagcgatagatcctgggcttgtttacgatctaagcctcactgattacttgaacttcttatgtgcttccggatacgaccaacaactcatttccgccctcaatttcaacaggacattcatttgttcaggttctcacagcgtaaatgacttgaactacccttcaatcacattgccaaatcttcgcttaaagcccgtggccattgctcgcacagtcacaaatgttgggccaccaagcacatacactgtaagtacccgctcgccaaatggatatagcattgccgttgtgccaccttccttgactttcacgaaaattggtgaaaggaagacattcaaagtcattgtgcaagcaagcagtgcagctacgcggagaaagtatgaattcggggattttcgttggacagacggaaagcatata

SEQ ID NO: 4165 - DNA, 987 bp, Glycine Max
tgttctctgcatatctggtttgtaatcccaaacaacacaccttcagccacggaatggggagacatgactttgacaaccgcgttttcttgttcgctcgccgctgcttctctctccaccgccgccagtttccgccggaataaatgcaccaccagcaagatttttcattcctcttccacgtgcatgccctctttcttgcatgatcatcactaccactctttcttattgcgagttgccaatgatgctgatagaagtgaagtgtcatctgatactgcaatcaagacatcgtattcagaagccgataagatggttgatggtatggactttggtgagctttgcaatgagtttgagtgcatcagcagtcccttggtagaatccactgcaagacaacttgcacgagatatacttgagctaagggagggaaatcgagcacttggaatctttgctgtttctgtcgcatacaaggatcctattaggagctttaccggtcgtgaaaagtataaaagacgactatgggcaaccggtgcactagacaacccatctgtgactgtgcaggaaatggtgatgctgtcaaccagtgttttaagtatcaagtggacaataagagggaaaccaaaatctgtgttaggaggagatctgataattagagttacttccaaatttactcttaaccaaattagtggccaagtcattgagcatgaagaattctgggacttatcagcttcatctgctagtgctcaggcatttttctggacatcacgtgctctctttgctgctgttgaatctgtcaaagatttgggtgacagtgctaagaatttgagtagtaaaatgtcaaccaaaaaagagaacttggagatgtatccagatccttcaggtgatccaaccaagttcttccagagggacgacagttttcaacaggatgcataccagattgcactactcctggcagttatttatttggtggtacaatttctaaggacaactttgtaa

SEQ ID NO: 4166 - DNA, 673 bp, Glycine Max
tttatagtttatactacaatcattataaatcaaaactgtgatccaattttattagcattactccaaatttggctcttgttgtttctatttcatgaaaaacaattagccttgtttgattttattccaaaggccaaatcaaaacagctttctccaaaaggaaatactagttgttcacccttggaaattttattatcccaaaagtggatttggggtaactggttgtcacctcttacctatgtacaaagagtagtttcattcaatgaatttactgccacaagatggatgcatcattcggctttcaagaacgacacaattggctacaatgttctcaatggatttgatataccaattgatgattactggtattgggttggttattactctagtatgtatgggttgttgtatagattacaattatggttattaggctatctatatcttaattataataatcgatatatgaatgatagaccttttgggagtactctagttgtcgttcttggtagataccagtcaaaccctgggagtgatcattggataactgctaagaagatcttggtgggtgccctgatgataagatcgacttctagatacatctttaggatgactgaggtgcaatatcttggaagagtaagaaataaactcgtgttcactcttttactatgcaagcaaa

SEQ ID NO: 4167 - DNA, 123 bp, Glycine Max
aaaagatcattgggttgtctagctgataaggagtatggggttcaacattcatggactaaattgatgataggttggaaatggtgctcggttcagatttgcaatttcccacttagttgtgtataa

SEQ ID NO: 4168 - DNA, 399 bp, Glycine Max
aaagttgtgctaagtgtggaactacatgatgacaaaattaagaaaaaagccatgaaggtagtctccaatctttcaggggttgaatcagtctcagtggatatgaaagagcaaaaattgaccttaattggagacatcgaccctgtggttgcagtggggaagctgaggaagctgtgtcacactgacatagtctctgttggaccagccaaggaggagaataagggaaagaataataaggaggagaaaaagaagccagcagtagcagagaatcaaaatcatcagaacttggatgatatggtgaaggcatacgaagcctaccaccacatgcataatcagatgaggcaaccggcttattattacataagtgtggaagagaatcctaatgcatgtgtcatttgctaa

SEQ ID NO: 4169 - DNA, 162 bp, Glycine Max
aacagggaaaagatacagataattgtgcaagatatttcacaaaaatctacaaaagtaagaagatgcaccaggctggcgaaggagcatagggccaggttctatatccttcgacgctgtgtcacaatgcttatttgctggcaagatcattgtgatgacccttag

SEQ ID NO: 4170 - DNA, 126 bp, Glycine Max
aactttctctgctgcttctataagctaatgcctcgaatagcacgcaaactctttcaagaacacagctattggttttggtatgtggatggtgagagtactgcagacaagcatgtgctgtgcagctag

SEQ ID NO: 4171 - DNA, 787 bp, Glycine Max
aattcggtgaactcagcatcatataagcctcctagtggagacacttttcccggtaaacctgctggaaggttctctgatggttgtgtcctcaccgattacattgcctcatatttgaaaattaaatcccccacaccttatatatttagaaattcctcggaactacaatatggtatgaactttgctcatggagggagtggtattttcaacacttcggttgatggaccaaacatgactgtccaaattgactcatttgagaatctaatcaaagaaaaagtctatactaaagctgaccttgaaagctcagttgctctagtgaatgctgcgggtaatgactatgctacatttctactacgacaacatgggagcatacaagatatgccagttttcactacaatccttatcaggcaaatgtctttaaatcttagacgcatccacagcttgggaataaataaaatagctgtcgggttattagagcctatagggtgtatgcctttgttaaccgtggcatcttcatatgagaaatgccttgagcctttcaacttgatctcccaaaatcacagccaaatgctactccaaattgtgcaagaactaaacaaggaattgggaaaaccagtgtttgtgacactagacctttacaactctttcctctctgtcatttcaactatgcagaaaaggcattctgaaaacccaacattgatgaatccgttgcaaccatgttgtgagggtgtgagtatggaatattcttgtggaagtgtggatgagaaaggagaaaagaaatattgtttat

SEQ ID NO: 4172 - DNA, 564 bp, Glycine Max
actcgatcccaaaaccctaggtttcagatccttaatcggccaggaccaaacagcatccgcggcagcgacggtaaccctccaacaacaacacttccgctgcgaaaaatgtctctggtggcgaacgaggatttccagcacattctgcgtgtgctgaacaccaacgtggatgggaagcagaagataatgttcgcaatgacctccatcaagggtattggaaggagattcgccaacatcgcttgcaagaaggctgatgttgacatgaacaaaagggctggtgagttgactgctgctgagttggatagtgtgatgactgtggtggcgaaccctaggcagttcaagatcccagactggtttttgaacagaaagaaggattacaaggatggcaaatactctcaagttgtgtctaatgctcttgatatgaagctcagggatgatcttgagagactcaagaaaatcagaaaccaccgtggtttgaggcattactggggccttcgtgtccgtggtcagcacaccaagactactggccgtaggggaaagactgttggtgtctctaagaagcgttaa

SEQ ID NO: 4173 - DNA, 330 bp, Glycine Max
actgagtttccacagcttggatccactcacagaccccacctttctgctgaacaccaaccacggcctcttccacagcatatatctgggccctgggctgcacaatcagcacctgctggaattggatatggacatcccgagaccatgatgccaccatttaatcctaatcaagttggtgcacactcatcatcagccatgtatctgcattcatctcagtatccctgtcagcgccctggaatgccatttatccatcatgaacatgttcaccaaccctttgcacagtctcatcagcccccacctgatgcaagttttggattggcccggccccggtga

SEQ ID NO: 4174 - DNA, 555 bp, Glycine Max
agagtgagcctgagcggatccattggtggcagtcgtacatcctgtctgactaactgcacaaagattctgctctccattaaaaaactcggggaaaatggctctacagtacaatcatgcagaccggtgtgtgaaagggtaccacctcatgattgtcatggattttgtgggctgtccaagaaaatagattctaagttccttaatccctctgggtgccaatgttccattgttcctgagagatcagaatcatcaggaactgagcacaatgagcatgatgatgacgatgagtcggaatcaaaacgtaggaaagttaagagccttggttcaagcataatgcaaagtgcatcggtgttggcacgagctcttaggagttgcgaggagaagaaggagaaacggcatcgtgaaatgatcgagctggagcaaaggcggattcagatggaggaagctcggaacgaggttcaccggcaaggcatcgccacccttgtcgcggccgtcaccaacctttccggtgccattcagtctctcattaataattctgaacgccatggccaaagataa

SEQ ID NO: 4175 - DNA, 328 bp, Glycine Max
aggatcaaagtatgtgggaagcttgtaaacaagctctttctgcatttaacttcagtgatgaagaaaaggactagatacttggaaaagcatttggaagttttgaaattcaagaccgtaaatggaatattagactacatgaggagtttaaatctttctgataatgatctgtccaagttgcttaaaaagtttccagaagttcttggatgtaatttggaggaagagttgaaaggtaatgtaaagatcctggaggagcagtggagtattaagggaaattctcttaggaaacttctccttagaaatccaaaagttttgggttacaatattgatt

SEQ ID NO: 4176 - DNA, 2310 bp, Glycine Max
agtttgaagattcattgcaacgagaaggacatgaacacactcctacgcttcaaaaaaggagtcagagatccttcaggcatgctctcctcatggctcccaaaattagattgttgtcgatggacaggagtcaagtgtgataatatcactggcagagttacacagcttaatctcccatgtcacacaactcaacctgaagttgttgcttatcaagagaaagacgacaaatcacactgcctaacaggtgaattcagccttaccttgctggaactagaatttttgagctacttggatttcagcaacaatgacttcaagtctatccaatacagttcaatgggtaaccacaaatgtgatgacttgtcaagaggtaaccttccccatctgtgtggaaactccaccaacctccattatcttgatttgtcacataattatgatctgcttgtctataatctccattgggtttcccgtctttcctcattgaaatatcttaaccttggaggtgttcgccttcccaaggaaattgattggcttcaatcagtcaccatgctcccttctcttttagagttgaccttggagaattgtcaacttgaaaacatctatccatttcttcagtatgctaattttacttcacttcaagttttaaatctagctggcaatgattttgtatctgagttgcctagttggttattcaatcttagttgtgacatctctcatatcgaccttagccaaaatcgcataaatagccaactccctgaaagatttccaaattttagaagtattcaaaccttgtttttatctgataattatctcaaaggacctattccaaattggcttggacaacttgaagaactaaaagaacttgatctttctcataattctttttctggtccaatcccagaaggcttgggaaatctatcatccttgattaatttgatacttgagtcaaatgagttgaagggaaatcttccagacaatctcgggcatctcttcaacttggaaacacttgcagtttcaaaaaattccttgactggaattgtgtctgaaagaaatttacgttcattaacaaatttgaagagcttttccatgggttcaccttctctggtctatgattttgatcctgaatgggtccctccttttcaacttgtaagtatttcattgggctatgtgagagacaaacttccggcatggctattcacacagagttctctaactgatctaaagattttagactcaactgcttcatttgaacctcttgacaagttttggaactttgctactcaacttgaatatttcgttttggtaaacagcacaatcaatggagacatatcaaatgtgttgctaagctcaaaattggtttggttagattccaataatttaagaggtggcatgcctcgtatatcaccagaagtgcgtgttttgcgtatatataataactcattgtctggatctatttctcctctcttgtgtgacagcatgaaaaataaaagcaatttagtgcatttggacatgggttataaccatttaacgggagaactcacagattgttggaatgattggaaatcgttggttcatattgatttaggttacaacaacctaacaggcaagattcctcactcaatgggctccttgtctaatcttcgttttctgtatctggaaagcaacaagttctttggagaggtacctttttcactaaataactgcaagaatctttggatacttgatcttggtcacaataatctttctggagttataccaaactggttgggtcagagtgtgagaggtcttaaattgagatccaatcaattcagtggcaacattcccacacagctatgccaacttggttccttaatggtgatggattttgcaagcaatagattatcaggaccaatacctaattgcttacataacttcacagccatgctttttagcaaagaattaaatcgtgtttatttgatgaatgacattgatctctcgaataacaacttgtctggaagtgtgcctttggagatttatatgctgactggattacaatccttgaatttgtcccataatcaattaatgggaacaataccacaagagataggcaacttgaaacaattggaggccattgatctctcaagaaatcaattctcgggagaaattcctgtgtccttgtctgccttgcattacctttcagtcttgaatttgtcgttcaacaatttaatgggcaaaatcccatcagggacccaacttggttcaacagaccttagctatattggcaattctgacctctgtggacctccgcttacaaagatatgcccacaagatgaaaaa

SEQ ID NO: 4177 - DNA, 3138 bp, Glycine Max
ataggagtcacttgtctctcccctgatggacaagcccttctttctcttctgcctgctgcaaaatcatcatcaccttccgttctctcctcatggaacccttcaagctcaacaccttgttcatggaaaggcatcacttgctccccacaagacacttttctcaacctctcctctttacctcctcagctctcctctttatcaatgcttcaacttctcaatctctcttccaccaatgtctctggctccattccaccctcttttggtcaactctctcatcttcagcttcttgatctatcctcaaactctctcactggttccatacctgctgaacttggaaggctctcttctcttcaattcctttacttgaactctaacagattgacaggaagcattcctcaacacctttccaatctaacttcacttgaagttctttgcctccaagacaatcttctcaacggttcaatcccatcacagttaggctctttgacatctctgcagcagtttcggatagggggcaacccatatctcaatggagaaatcccctcacagttaggcctactcaccaaccttaccacttttggtgcagctgccactggactttctggtgccattccctctacatttggtaacttgataaacctacaaactcttgcactttatgatactgaaatttctggttcaataccaccggaactcgggtcgtgtttggagctgagaaatctgtacctatacatgaacaagctcaccggttctatccctcctcagttgagcaagttgcaaaagcttactagcttgttactttggggaaatgccttaactggtccaatcccagcagaggtttccaactgttcatcgcttgttatatttgatgtctcttctaatgatctctctggtgaaatacctggggactttgggaagctggtggttctggaacagcttcatctatcagacaattcactcacaggtaaaataccatggcagttgggcaactgcaccagcctctccactgttcagcttgacaagaatcagttatcaggtaccattccatgggagttaggcaaattgaaggttctgcagagttttttcttgtggggtaatttagtgtctggaaccataccatcctcttttggaaactgcacagaactatatgcacttgacctttcaaggaacaagctgacaggttttataccagaagagattttcagcttgaagaagctgagtaagcttctgcttctgggaaattcattgacaggaaggttgccatcaagtgttgcaaattgccagtctttagtgaggctgagggttggagaaaaccagctttcggggcagattccgaaagagataggccaattgcagaatctggtgttccttgacttgtacatgaatcgtttctctggaagcataccagtggagattgccaatatcacggttcttgagctgttagatgtgcacaacaactacctcactggggaaattccatctgtggttggtgagcttgaaaatttggagcagcttgatctcagtagaaacagtttgacaggtaaaattccttggagctttggaaacttcagctatttgaacaagctcatcctcaataacaacttgctgacaggatcaatcccaaaatccattagaaatttgcagaagttaactcttcttgatttgagttacaacagcctttctggtggcatacctcctgagattggtcatgttacaagcttaaccatcagtttggacttgagctcgaacgcatttacgggagaaatcccagattcagtgtctgctttgacacagttacaatcacttgatctttctcataatatgctttatggagaaatcaaggttctggggtctctcacgagtctcacttctctcaatatctcctacaacaacttctcaggtcctatcccagtaactccattcttcagaactttatcttctaattcatatcttcagaacccccagctttgtcagtccgtggatgggactacatgttcttcaagcatgattcgaaaaaatggtttgaaatccgcaaaaaccatagctttggtcacagtcattctagcctcggttactataattctcatttcatcctggattctagtaactcgtaatcacggatacagggttgaaaaaacactgggggcatcgacttccacatcaggtgctgaggatttctcttatccttggactttcatcccatttcagaaaataaacttcagcattgataatatcttggattgcttgagggatgaaaatgtcattggaaagggttgctcaggtgttgtgtacaaggctgagatgccaaatggggagttgatagcagtgaagaagctatggaaagcaagcaaagcagacgaagcagtggattcttttgctgcagagattcagattcttggatacattcggcacaggaacattgtgaggttcataggttattgttctaacaggagtattaatcttcttctctataactacatcccaaacggtaatctgcgacagctgttacaagggaacaggaacctagactgggaaacaagatacaagattgctgttggatcagctcaaggtctagcttaccttcaccatgattgtgtccctgcaattctccatagagatgtgaaatgcaataacatactcctagactccaaatttgaggcatatctggccgatttcggtcttgcaaagctaatgcattcaccaaattatcatcatgcaatgtccagagttgctggttcctatggttacattgccccagaatatggctactccatgaacataacagagaagagtgatgtctatagttatggggtggttttgctagagatactaagcgggcgtagtgctgttgaatcccatgttggagatggtcaacacatagtggagtgggtgaagaggaagatgggaagctttgaaccagctgtatcaatactagacacaaagctccaaggtctgccagatcaaatggtgcaagagatgcttcaaacacttggcattgctatgttttgtgtgaactcttccccggcagagcgcccaacgatgaaggaagtggttgcactactaatggaggtcaagagccagcctgaggagatgggcaagacctctcaacctctaataaaacagtcctcaaatcaaagctga

SEQ ID NO: 4178 - DNA, 645 bp, Glycine Max
atgaaaagaaaggccatgagttgtgacaaccgagatgctgtgaacagaggtgcttggtcagctgaggaagaccaaatccttatcaactacgttcaagcccatggagaaggaaattggagagagctttccaaaagagctggtttaaaacgacgtgggaagagttgcagactcagatggttgaactatctcaagccagatatcaagagaggaaacatttcttcggatgaagaagatctcatcatcaggcttcatagcctcttaggcaataggtggtctcttattgcgggacgattacctgggcgaacagataatgaaatcaagaactattggaatacttatttgagaaagaaggttgagcaaaatcacaactataacagtaatcttcctggtcatgataacattcctatcaaattaagaattgaatctccacggcgctcaaaaaattcattgggtattgttattgatcctacaaaatcctctcacccaatgacgattaaatcaatgaggtgcaccgaggttatgatgccaacgcgatccgtcaatgattttacaacaagttgggatataaacccttctgcatctaccccacaagatggccatgatcattgctcagaaggtttcctcaaacactttggtattagtgac

SEQ ID NO: 4179 - DNA, 1131 bp, Glycine Max
atgaaaattttttacctctcacacttcaccttcttcttctttattccttgctcttcaatggcttccgatcttgagcttaaggccaaagaggctttcgaagatgataactatgatctcgcctacgacctcttaactcaggccattggtctcagccccaacaacgcagacctatatgctgaccgtgcgcaagtcaacatcaaagtcaacaacctcaccgaggctgtttctgatgcaaacaaggcgattgagttgaatccttctcactcaaaagcatatttgcgaaaaggtaccgcatgcatcaagcttgaggaatatcagactgctaaggcagctctagagatgggtgcttcattggctcctggagattctaaatttactgatttgatcaaagactgcgatgaactgattgcagaagaatctggtgtcatacccatacaagaagagagcacaacacagggtgctgctacaaaagctgttgaggcagagaatgatcttccagagccacctacagtaaccgtggttaaacctaaatacaggcatgaattctaccagaaacctgatgaaatggttattaccatatttgcaaagggcattccacgagacagcattactgttgactttggtgaacaaatattaagtgttacaattaatatcccttgcaaagatgcttatgtcttccaacctcgcttatttggaaagatcataccctccaaatgccggtatgaagttttgtccaccaaaattgaaatttgccttgcaaaagcagatcatatccaatggacatctctagaattcaacaagggtagcacagttgcacagaggtttagtgttttgccagttgcaagaggtgaaaaacctacttatccatcctcaaaaccgaaaataacagattgggataagcttgaagctcaagttaagaaagaggagaaagaagaaaaacttgatggtgatgctgcgttgaacaaatttttccgtgatatatatcaagatgcagatgaggacacaagaagagcaatgagcaaatcatttgtggagtctaatggaacagtactgtctacaaactggaaagaagtgggatcaatgaaggtacaggaaagtcctcctgatggcatggagttaaagaaatggtaa

SEQ ID NO: 4180 - DNA, 282 bp, Glycine Max
atgaaatcatttggcagtggaaggaggaattcggtgctagttttgggagctactaaaagaattaaaaagagcaccatctattacagtattttgagatggatgagtgtttggtgtgcgacatgtgtagaacctttgattttcatccattctgttcttgctggctctgacaaactcaccatgggcattcttgaggcaaataccccaacttgtaatctgttgctatgtattgaagccagcatctacattgcacttggaggaggttcccaccgagcaatgttctga

SEQ ID NO: 4181 - DNA, 282 bp, Glycine Max; identical to SEQ ID NO: 4180

SEQ ID NO: 4182 - DNA, 282 bp, Glycine Max; identical to SEQ ID NO: 4180

SEQ ID NO: 4183 - DNA, 288 bp, Glycine Max
atgaaatcatttggcagtggaaggaggaattcggtgctagttttgggagctactaaaagaattaaaaagagcaccatctattacagtattttgagatggatgagtgtttggtgtgcgacatgtgtagaacctttggtagggattttcatccattctgttcttgctggctctgacaaactcaccatgggcattcttgaggcaaataccccaacttgtaatctgttgctatgtattgaagccagcatctacattgcacttggaggaggttcccaccgagcaatgttctga

SEQ ID NO: 4184 - DNA, 288 bp, Glycine Max; identical to SEQ ID NO: 4183

SEQ ID NO: 4185 - DNA, 417 bp, Glycine Max
atgaagaaagttgtgttgaaggtggaaatacatgatgacaaaatcaagaaaaaagctatgaaggctgtctctggcattttaggggttgagttagtttctgcagacacgaaagacaagaaattgaccataattggggacattgatccagtaaaagtagtagccaagctaaggaagcagctttgtcacgcagacatagtttttgttggaccaacaaaagaggagaagaaggaagaacctaaaaaagattcagcaaaagaaattgttgtaacaatagcttatggcaaaccgagaaaattattggctgagtcgcggacaatgtcgctttttttaagacgtttcgtggcactgccaaaaattatgcaagcagactatctaccacgaagtccccaggataaaacagcccaaattactgtataa

SEQ ID NO: 4186 - DNA, 411 bp, Glycine Max
atgaagaaagttgtgttgaaggtggaagtacatgaagacaaaatcaagcaaaaagctatgaaggttgtctctggcatttcaggggttgagtcagtttctgtggacatgaaagacaagaaattgaccgtaattggggacattgatccagtaaaagtagcagccaagctgaggaagctttgtcacgcagaaatagtttcagttggaccagcaaaagaggaaaagaaggaagagcctaaaaaagatgataaaaaggaagatgacaagaaaaaaaatccaccaagcgaaatcgtggcagatcaactcaagttctatcaaacccatgcctattattatcagatgaaaccacaatacaatccatattacagtgccataagtgtggaagaggatcctaatagctgtgtcattatctaa

SEQ ID NO: 4187 - DNA, 1896 bp, Glycine Max
atgaagcaagggtcagcaaacaaccaacagctcttttgggcaagagtggttatgcgcaaatggcttaacatggctagtaacgagcctgattacaccgctgaccctgatgatgataatgaggatgaccctgaaagtgactcagataatgaagagttgggaaaacggacacggtttggggacagcagagaggaacaagctccaattgagtcaaatgaatttcttccaaggttaaggaggcaaaagtcattaacttctaggtctcagtatataaacaaaaaggaactaagagtttgtgttggaacatggaatgttggaggaaagcttccatctgatgacctagatattgatgattggttaggcattaacgagccagctgatatctatgttcttggtcttcaggagattgtaccattaaatcctggtaacatttttggtgctgaagacactcggccggtaccgaaatgggaaaacattattcgagatacactgaatagagttagaccaaaagcaccaaagatgaaatccttcagcgatcccccatcaccatcaaaatttaagccatcagatgatgcgccagacatagaagaagaaatattacttgaaagtgatggtgatattggtgaggaagtccatccgttggatgaagaacacaatgtttatgatggaggtgcagataaaccaaccacatatgaagaagcctcgaatactaattttcaggcttcagatgctgctgatattgccaacacagaagaaccaataggcaatgatttaaagagacagttttctgatggaaagaggttgagtaggctgaattgtttccgtgacgaaaatttgcccaaaaaaacagaaacatcatcttctcaacaggccagtaagctatccagaatgattagtagttctgataggattggattgagctggccagagccaccactacatctgctatctcagggaccattggatagaccaacttcttttaaatctgtcagatccttttcagcatcaaagtctttcagaacatgtcagaccttcaaaaaaaccatagatgacataggtttgcttgctgaaattgaccttgaagctttaatgaagcggaaaagaagatcatcatatgtaaggatagtgagcaaacagatggttgggattttcatcaccatatgggttcgtcgtagcttgcgtaaacatattcagaatttgaaggtgtcaactgttggggttggtgttatgggctatattggtaacaagggatcaatatctatcagcatgtctatataccagacactcttttgtttcatatgtacccatcttacggcaggtgaaaaggagggagatgaacataaaagaaatgctgatgtgcgtgaaatacatcaacgaactcatttttattctcttgcggatattggagttcccagaaacatccttgatcatgagagaataatttggttgggtgatctgaattatcgtatcaacttgtcatatgagaaaacaagagattttatctcaaaaaaacaatggtccaaattgattgagaaagaccagctttcaaaagagctcgagaaaggtgtgtttggtggatggtcagaaggcaagttaaattttccaccaacgtataagtatgagaataattcagataaatactatggagaggacccaaaggttgggaggcgcacaccttcatggtgcgatcgtattctctcctatggcatgggaatgagattactaagatatggaaggactgaactcaggttttcagaccacagaccagtgactgccacatacatggctgaggttgaggtgttttctccaaggaagttgcagaaagccctgacttttactgatgcagagattgaaaatgaagaagtcatggcaactttagggacactgtatgaattctga

SEQ ID NO: 4188 - DNA, 348 bp, Glycine Max
atgaagctcaaacttctcaaatgctgcataagggaattttataaattcattagaaaggtcagtgctaattttcccaattatgcaatattggttacatgttgttcctcgcatgaaaagtcacactcatacgtacccaaagatgtcccaaaaggtcacctagttgtctatgttggtgaggattgcaagagatttgtgatcaaagtaggtatgctcaaccatccactcttccaagccttgctggaccatgcagaggatgtgtttggattcaccaatgattctaaactccgtatcccttgcaatgagaacattttccttcttgttcttcacaatgctggtgatcttgtctag

SEQ ID NO: 4189 - DNA, 1614 bp, Glycine Max
atgaataactctgtttcagaaaacagtttcatcattgagagtgatgaagaagacgaggagaaggatttgaacaaaggtgaaggtggtggaaacgattctgattcttccaattactcaaatgaaaaccctccacagagaaagcccagttcttacaacatctcatggcctcagagttacaggcaatctattgatctatatagtagtgtgccatcaccaaacattggatttttgggcacaccctcattgtcaagactaagcagttctttcctttctacatcactaacaaggaggcacactcctgaagcacttccttcattgacaaagcctctgatacaacaagacacagaagatgagcagcatcagagacgtagctctcataccttgcttcctcctcttccttctagaaggtcttctttgattaagaaggattccaaggttgctcatcttgaagttccctctcgccactgctcttttgggcaagctatgcttaatggcataaatgttctttgtggtgttggaatcctttctacaccttatgctgccaaagtaggtggatggcttgggctttctatattggtcatttttgcaattatttcattttatactgggctgctcttgcgttcctgcctggacagtgaacctgagcttgagacgtatcctgatattggccaagctgcatttggtactactggacgtattgccatttcagcttgttgcattgaatatataattttggagggtgacaatttgtcttctttatttccaagtgcacacttgaatttgggtggaattgaactgaattcacgtactttgtttgctgtgattactaccttggctgttcttcctactgtttggctccgtgacctaagcattctcagttacatatccgctggtggagttgttgcatcgattttagtggttctctgcttgttatgggttggcatagaggacgtaggctttcatagcaaagggaccacactcaatctttcaactcttcctgttgctgttggtctttatggttactgctactctggacatgcagtgttcccgaacatttatacatccatggcaaatccaaaccaatttcctggagtgctcttagcatgttttggtatttgtaccttattgtatgctggggctgctgtaatgggatacacaatgtttggagaagctatactgtctcagttcactctcaacatgcctaaagaattggtagccacaaatattgctgtctggactacggtggttaatccatttaccaagtatgcattgactatatctccagtggcaatgagtctggaggagttgataccgtcaaaccatgccaagtcttatctatattccatcttcatcagaacagggctggttctttctaccctatttattggtctctcagttcccttttttggtctggtgatgtcattgattggatcattactcacaatgcttgttactttgatactaccctgtgcttgtttcctaagaatcttgcggggcaaagtgacacgaatacaggcagcactttgcattacaattatcacagtaggtgttgtatgttctgcttttggaacatactccgccctctccgagattgtgaagagtttgagggagtga

SEQ ID NO: 4190 - DNA, 1521 bp, Glycine Max
atgaataactctgtttcagaaaacagtttcatcattgagagtgatgaagaagacgaggagaaggatttgaacaaaggtgaaggtggtggaaacgattctgattcttccaattactcaaatgaaaaccctccacagagaaagcccagttcttacaacatctcatggcctcagagttacaggcaatctattgatctatatagtagtgtgccatcaccaaacattggatttttgggcacaccctcattgtcaagactaagcagttctttcctttctacatcactaacaaggaggcacactcctgaagcacttccttcattgacaaagcctctgatacaacaagacacagaagatgagcagcatcagagacgtagctctcataccttgcttcctcctcttccttctagaaggtcttctttgattaagaaggattccaaggttgctcatcttgaagttccctctcgccactgctcttttgggcaagctatgcttaatggcataaatgttctttgtggtgttggaatcctttctacaccttatgctgccaaagtaggtggatggcttgggctttctatattggtcatttttgcaattatttcattttatactgggctgctcttgcgttcctgcctggacagtgaacctgagcttgagacgtatcctgatattggccaagctgcatttggtactactggacgtattgccatttcagcttgttgcattgaatatataattttggagggtgacaatttgtcttctttatttccaagtgcacacttgaatttgggtggaattgaactgaattcacgtactttgtttgctgtgattactaccttggctgttcttcctactgtttggctccgtgacctaagcattctcagttacatatccgctggtggagttgttgcatcgattttagtggttctctgcttgttatgggttggcatagaggacgtaggctttcatagcaaagggaccacactcaatctttcaactcttcctgttgctgttggtctttatggttactgctactctggacatgcagtgttcccgaacatttatacatccatggcaaatccaaaccaatttcctggagtgctcttagcatgttttggtatttgtaccttattgtatgctggggctgctgtaatgggatacacaatgtttggagaagctatactgtctcagttcactctcaacatgcctaaagaattggtagccacaaatattgctgtctggactacggtggttaatccatttaccaagtatgcattgactatatctccagtggcaatgagtctggaggagttgataccgtcaaaccatgccaagtcttatctatattccatcttcatcagaacagggctggttctttctaccctatttattggtctctcagttcccttttttggtctggtgatgtcattgattggatcattactcacaatgcttgttactttgatactaccctgtgcttgtttcctaagaatcttgcggggcaaagtgacacgaatacaggtatga

SEQ ID NO: 4191 - DNA, 222 bp, Glycine Max
atgaatcccaaaaattatcagctatatttaatttgtaaaattaagtacttatcagttaaaaaccatcagctttatagcatagccaggagatatatcatgagtaccatttgtagacgtttaaacataaatgaaaatgataatttttccaattactccacaaataaacatatttcccttcaccccttttgcattcattggactccctacataatgctgaagtac

SEQ ID NO: 4192 - DNA, 441 bp, Glycine Max
atgaatcgccgcgaaaagctttccctcttgaacgcgttcttcagaacccgacgcccttttcaccaatccccaattgttgctcccttcactccaccgacccacgtcgcgtccacctcaaagttccactcttttcccacaatccctcacacccacttcgcgattcggcaatatccgagaagtttcgctggtgggtctggcgcgttggaccacaccaaggaggtggacaccatcaacctcaagtttgcagaggcgagggaagagatagagatggcgttggagtccaaagataccgtttatttcgacgaggaagccgagtgtgcacgcgccgccgtcaacgaggttttgggcatgttcgagggattgttggctaagttgccagagagggaaagaggggctctgcagagtaagagcttgattgtgcggctgatagaattgctttag

SEQ ID NO: 4193 - DNA, 1269 bp, Glycine Max
atgaatgctccacctcatcatgacgatgaagacgacaacgaacaagttttccttgatgagtctgacatcatccatgaagttgccatggataatgaagatcttcctgacgctgatgatgattctgaactcgaggaggaggatagtaattttgtgcacaaattcactgctcataccggtgagttgtactcagtttcctgcagccccacagatgcagccttggtggttactgggagcggtgatgacagaggatttctctggaagattggccaaggagattgggcttttgagcttcaaggtcatgaagaatctgtatctactttagcctttagctatgatggtcagcaattggcatcagttagcttagatggaatcattaaagtctgggatgtatctggaaatttggaaggtagaaattttgaaggacctggagggggcattgagtggcttaggtgggatccaagaggacacagactcttagctggttctgaggatttcagcatttggatgtggaatactgataatgctgccttacttaaaacatttattggtcatggcaatagtgtaacctgtggtgattttactcctgatggtaataatttttctttatcttgggaaataatatgtactggttctgacgatgcaaccttgagaatttggaattcagaaagtggaaaaagcactcatgttgtgcagggccatccatatcataccgagggattaacatgcttgacaataaattcaacttcaactcttgctctttctggatttattcaaagagtaatagcctctaatgtcagttgcaatagttcgagtgaagagcaatgttttcttggattactgttgtcttgtgatttcctcatttctgtcaagggcaaagggaacaagcatgttgttgataataatgcccttgcttctcattcagattccattgagtgtgttgggtttgcaccaagtggttcctgggctgcagttggaggcatggataaaaaactgatcatctgggatatagagcatttattaccccgaggcacttgtgaacatgaggatggagtatcatgtttggcatggcttggtgcatcttatgtggcttctggttgtgtggatggtaaggtgagattgtgggacagccggtctggcaaatgtgtaaaaacattgaaggggcactctgatgccattcagtctctttctgtgtctgctaatcacgattaccttgtctcggcctcagttgatggaacagcttgtgcttttgaggttgaaattttcggatga

SEQ ID NO: 4194 - DNA, 549 bp, Glycine Max
atgaattattctcttgccctagccctaggcctaatcctcatttcttgttctcctttgctagcaaacgctagaggccaccatcatgcaggtggccatcatctagggttggtagggcaaatctgcacggaactcatccaaaaccagacgacttgcacggaccttgtaaaggcagcagatcctaaaattgcacaggcaaagacattccaagagcttgcacaggcagtgctagaatttgccgtgaacaagggaatagagggccaaaccttcctcaagggcttggcactgattgagcaatcaccagccattaaggaatgtgcaaactttttctatgatggggtggttggatccttccgtagtgccttacgtgagttgaaagaagatgctcagaccgctagctatgatgccaaagcggcttatgatggccctgacggttgcaatagagccttggccgctgaaaatatcaataaccctgctattactgctcttaacagcgaaatagcgttgcttagccaaattgcattcgaggccatatgcaaatattctaattaa

SEQ ID NO: 4195 - DNA, 480 bp, Glycine Max
atgaattcttcagcattatgttctctgatgctcaccctttgcttgatcctaatttctcattctcttttgctagcaaatgctaaagccaatggtcatcgtggcctacttggaaatagtcagaagccgatgattgaccaaatttgcaaccaaacctcagagaatgaaaacgagtgccttaacattttgaaagcagatccaaaaatcgtgcaagcaaaagactattttgaaatttcaaaggcgatcctagagttggccataacgaagtcaaaaaaggggcaggaattcctcaaagggttggcacaaaaaactggttctccagccattgctttgtgtgcaaaccaatggtatccttacaccgttggatcgttagggagtgccctagctgagttgaaagaaagtcctgatactgccagttatgatgccaaagttgctggtgatggacctgtatactgtgaggaagccattgctaaagcacatatt

SEQ ID NO: 4196 - DNA, 861 bp, Glycine Max
atgacaaacccattagagagataccaaaaacttgggctaagcgagtctctaccgaaaacctacagatacccaattgcgtgcagagagctaagctttattctgagggaagcttttcatcaattccccaaaaatttgcaatccatcgtcttccaagacaccctctccgccttccgtctcctcccagaaatacagactcagagtgctgtttcagcagtccacttcctccttcagagtgtagaagcagcactaccaaagcaaaaaaagaatgtggctgtaacagaatttaagcatgcaatggttgctcataagaggcgctgtaaagctcaccaggtagagaaaggttcattgccattgccacaagatattcttgtgctcattttcagttttcttgatatgaaatctttagtctcagtggggcttgtctgccggtcatggaatatagctgcaaatgataaccatctgtgggagatgcagtatgttgcactgtttggtggtcgtgctaaactggttgaaggcaagaacaataggcttttgctggaacccatagatactagaatcattactgattggaaagaagctgttaaaggagcatatactggagcattatccaggatattaacaaccagtcggggatattgtggacactgcaaatcagtagtttggttaaataactcaaaatgccccaatgtacactctggaatatctgaaattcaagatattaagcctgtaacagcattccaggctgtggaatatgttctagaggattctctatcagtaacatcttcctcagacagtgatagtgattcggaaggaggaacagtttctaggttatgggcatatcccaagcatataagaaaataa

SEQ ID NO: 4197 - DNA, 489 bp, Glycine Max
atgacagacttgtcactctacaagtgggtttcgtttcctgtttcaacgatatgggacactgctgggcaagagagattccagagtctcggggttgcattttacagaggtgccgattgctgtgttcttgtgtatgatgtgaatgtgatgaaatcgtttgatacccttgagaactggcacgaggagtttctcaaacaggcaaaccctcctgatccaagggcatttccgtttattttactcggaaacaagatcgatattgacggtgggaatagtcgagtggtttctgagaagaaagcgaaggactggtgtgcctcaaaagggaatattccctactttgaaacatctgcaaaagaggattacaatgttgatgctgcattcctgtgtattgccaaggctgctctagccaatgagcacgaacaagacatatattttcaagggattcctgaggcagcagttccagagaatgagcagaggagtggatgtgcatgctga

SEQ ID NO: 4198 - DNA, 1245 bp, Glycine Max
atgacagtttctgttcttgttgatgtcacaacctctgctttgtgccctggagagtcaacttgctcaaaagctatttacatcaatggggtccaacaaacgattgttggaattttcaagatggtggtacttccactactgggtcagctctcagatgagtatggccgtaaacccttgctcctgattaccatatccacggctatatttccctttgttttacttgtctggcatcagtctgaggaatatgtctatgcctactatgtgcttcgcacaatttcaaatataatcagtcaagggagtattttctgcatttctgttgcatatgcagcagatgttgtcaatgaaagcaaaagggcagcagtatttggttggattactggtctcctttctgcttcacatgttctgggggatgtactggcttggtctcttcctgaaaagtacatttttgcggtttcaatagtactattgacttcttgtcctgtttatatgaaattcttccttgttgaaacggtgataccggctccgaaaaatgatcgtgagtcaggttgctgggctaaaattgttgatgttccccgacaaagatatatatctatgaggagagctgcggaaatagtaattttcagtcccactttgaggggcatggctcttgtgtccttcttttatgagctgggaatgtcaggcataagcagtgttttgctgtactatttgaaagctgtttttggttttaacaaaaatcagttctcagaacttctgatgatggtgggaattggttcaatcttttctcagatgttgttgcttccaatactcaatccattggttggagagaaagttatactctgctctgccttgcttgcatcaatagcatatgcttggctctatggattagcatgggcaccttgggtaccatacttaagtgcctcttttggtatcatctatgtccttgtgaaacctgccacttatgctattatttcaaatgcgtcaagctcaaccaatcagggaaaagcacaaacatttattgctgggacacaatctatatctgatttgctatctcctattgctatgagtccattgacttcatggtttttatctagcaatgctccttttgaatgcaaaggttttagcattatatgtgcatccatatgcatgataatttctctttgttttgcttgcttgctgaagccagctgatactagttcgagtaatgacatagagggaagccaagagaccccgcttctgactgataattga

SEQ ID NO: 4199 - DNA, 1332 bp, Glycine Max
atgaccgaaccttccaaggtcattcacgttcgaaatgtgggccacgaaatatctgaaaatgacttacttcagctgtttcagccttttggagtcataacaaagcttgtcatgctgcgtgcaaaaaatcaggctcttatccaaatgcaagatgttccttctgcagttaatgctttacaattttatgcaaatgttcagccaagcataagggggaggaatgtttatgttcaattttcctcacatcaggaattaacaacaatggatcaaagtcaaggacgaggagatgagccaaaccgaattctcttagtcacagttcatcacatgttgtatcctatgactgtggatgtgctgtatcaagtattttctccccatggatctgtggaaaagattgtaacatttcagaagtcagctggctttcaggctctcatccagtatcaatcacgtcagagtgctgttgcagcaagaagtacacttcagggacgcaatatttatgatggttgctgtcagctggacattcagttctcaaaccttgatgaattacaagtgaactacaataatgaccgttcaagggacttcacaaacccaaatctccccacagagcagaaaggcagaccttcacaacctggatatggtgatgcaggaaacatgtatgctgcccagggttcaggagccagggcagttggatttccacagatggcaaatgctgcagccattgcagctgcctttgggggaggtctgcctcctggaataactgggacaaatgacaggtgtacagttcttgtatcaaatcttaatcctgatagaattgatgaggataaactattcaacttgttctctatttatgggaacattatgagaattaaacttctccgaaataagccagatcatgcacttatccagatgggagatggttttcaagcaaaactggctgtacactttctgaggggagccatgttgtttgagaaacgattagaggtcaacttctccaagcatccaaaaataaccccaggtgctgacacacatgaatacatcagttcaaatctcaatcgtttcaaccgtaatgcagccaaaaactatcggtattgctgccccccaacaaagatgattcatttgtccacacttccactagacatcactgaagaggagattgtgagccttgtagaggaacatggaatcattgtcaacagcaaagtcttcgagatgaacgggaaaaagcaggctctggttcagtttgaaaatgaggagcaggctactgaagcccttgtgtgcaagcatgcaagtacactttctggctcagtaatccgtatctccttttcgcagttacagaatatatga

SEQ ID NO: 4200 - DNA, 237 bp, Glycine Max
atgacgaatgctgattgtgagatatggtactgtgaatattattcaaagcctttccatctcttctgctttcttccctctgccatcactaatgctgctgctcttcttcttcatcttcctcttcctccttcttcttcttcttgttattattattattattattgttgttgttgttgttgttgttgtttattgctggcagtgggtagagatggtggaggttgtgggtcttgtgtgctctga

SEQ ID NO: 4201 - DNA, 1857 bp, Glycine Max
atgacgcgcctcagaaaactcggcaccgtcgccacggccattgccaccgcgtacggtggcgccctcatcctgcacgagcctctcgtctccgccagcgatcacggaggcggttcccgcctcgaggcactccggaagaaggtgcacgactccgacgccgtcgtgccggccaggaaggcgcagctttcagcgctcgaggccgccggaaagtcgaatccgctcgacgttctcgtcatcggcggcggcgccaccggttccggcgccacactcgacgccgtgactcgaggactccgcgtcgggctcgtggagagggaggatttcgccgccggaacttcgtcgcgatccacgaagctccttcatggaggtgttcgatacctggagaaagctgtatttaaccttgactatggacaattcaagttagtgcttcatgcccttgaagagcggaaacaggttattgaaaatgcaccacacctatgtcatgcattgccatgcatgactccatgttttagctggtttgaagtagtgtactactggatgggcttgaaaatgtatgatttggtcgctggaagacaactgttgcacttatcaagatattattcgacaaaagagtctgttgagctctttcccactctggcaagggaggtaaatgatagaaccctaaggggcacagttgtttattatgatgggcagatgaatgatgcacgacttaatgttggattggcttgtactgctgctctagctggtgcagcagtgctgaaccatgcagaagttttatcattactgaagaatgatgatggaaaacgggttattggcaaagagtttgatacatatgcaaaagtaattgtgaatgcgggtgggccattttgtgactctataaggaaaatggccaacaaaaatgcacaggaaatgatttctcccagcagtggggtgcatattatactccctgattattattctccagaaggaatgggtctaattgtccctaaaactaaggatggacgtgttgtttttatgctgccatggctgggaagaacagttgctgggactacagattctagtactagcattacttatcttccagaaccacatgaagatgaaatacaatttatattggatgccatctccgattaccttaatgttaaagtacgccgtgcggatgttctttctgcttggagtggcattcggccattagcagtggacccaacagccaaaaatactgagagtatctcaagggatcatgttgtttgtgaggattaccctggtttggtcaccatcactggtggcaagtggactacctatcgaagcatggcagaagatgctgttaatgcagctataaagtctggaaagctgacccccaccagtagatgtgtgaccaacaatctccggcttgttggtggtgaagggtgggagctttcttcttttacagttcttgctcaacagtataagcgcatgaaaagtacatatagtggtaaagttgttcccggggtaatggattctgctactgcaaagcacttgtctcaggcatatggaacattggctgagcgtgtggctaccattgctcagaatgaaaatttgggtaaacgacttgcccacggttacccttatctggaggcagaagtggcctactgtgctcgtaatgaatattgtgaatctgctatcgatttcattgcaaggaggactcgtcttgctttccttgaaactaacgcagcacgaaaggcattgcctcgcgtgattgaaatattggcaaatgagcacaagtgggacaatccaaagcagaaggaagagttggagaaggctacagagtttttgaagacttttaaatcctccaaaaatgctcagttccacgatggaaaacacagt

SEQ ID NO: 4202 - DNA, 756 bp, Glycine Max
atgacggacggcttctggaatcggcagcagccgcttcacccttcttccaccatgctcaaacgacctcgtactgaatatgatatgtcaccttctggtctgacttcagggggtaatgaaatgcataattatattgctcgaaatgatgaccacaccggtcatcgaatgctaaaggacactaaaacaattggatctgcttatgatcggtaccttcaaagtgcagggcttacttcttttaattctggggaagccagtgcggttggcggtgttggattgggaaggggtgctggtggattgccacaccattcactaactgatcctgctgtcatggggcatcctggtggtggtcatgatcatgcacgaaatggacggaatgtcaattatggtggtcagttaccattagatgcagcttccatgcctggacctgagactgtacctctacccccagatgcttcaagtactttatatgttgaaggtctcccatctgacagcacaagaagggaagtggctcatatttttcggccttttgttggatatagagaagtgagacttgtgagcaaagaatccaaacatcgtggtggagatcctctaatcctttgttttgtggattttgctaatccggcctgtgcagcaactgctctgagtgcattgcaaggttataaagttgatgaactcaatccagagtctagccacttgcggcttcagttctctcggtttcctggtcccagatctggacctggacctcgtggcaagaggtga

SEQ ID NO: 4203 - DNA, 597 bp, Glycine Max
atgacggacggcttctggaatcggcagcagccgcttcacccttcttccaccatgctcaaacgacctcgtactgaatatgatatgtcaccttctggtctgacttcagggggtaatgaaatgcataattatattgctcgaaatgatgaccacaccggtcatcgaatgctaaaggacactaaaacaattggatctgcttatgatcggtaccttcaaagtgcagggcttacttcttttaattctggggaagccagtgcggttggcggtgttggattgggaaggggtgctggtggattgccacaccattcactaactgatcctgctgtcatggggcatcctggtggtggtcatgatcatgcacgaaatggacggaatgtcaattatggtggtcagttaccattagatgcagcttccatgcctggacctgagactgtacctctacccccagatgcttcaagtactttatatgttgaaggtctcccatctgacagcacaagaagggaagtggctcgtatcctttttgttctcatttctcagttattgtttaataattgtaccatcacactttcaattatgctttgtcagcttcatttattttag

SEQ ID NO: 4204 - DNA, 552 bp, Glycine Max
atgacggacggttcctggaatcgacagcagtcgtttctccctccttccgccatgctcaagcgacctcgtactgaatacgatatgtcaccttctggtctgacttcagggggcaatgagatgcataattatattgctcgaaatgatgaccatactggtcaccgaattctaaaggacactaaaacacttggatctgcttatgaccgctaccttcaaagcgctgggcttacttcgtttaattctggggaagccagtgcaattagcagtgttggattgggaaggggtgttggtggattgccacatcattcactaactgatcctgctgtcacggggcatcctggtggtggtcatgatctttcacgaaatggacgtaatgtcaattatgccagtcagttaccagtagatgcagcttccatgcctggacctgagactctacctctacccccagatgcttcaagtactttatacgttgaaggtctcccatctggcagcacgagacgggaagtagctcgcatcctttttgttctcagatactggataggaattttatattga

SEQ ID NO: 4205 - DNA, 1692 bp, Glycine Max
atgacgtgtggcaagaatctgttcctccaaattctgtggtgtttttccttgatcggtcttagttcccaagcacagaattacacttttgttgtgacagaggtcaagtacacaagactctgttccacaaaaaacatattgactgtgaatggagaatttccaggaccaactatcagagccaccaggggagacacaatctttgtagatgtttacaacaagggcaacttcaatattactttacactggcatggggtgaagcagccaaggaatccatggacagatggtccttcatacattactcagtgcccaatccaacctggaaggaaattcacacagaggttgatttttactttcgaggaagggaccatatggtggcatgctcatagtgaatggttaagagccactgtctatggtgctatctatatctatcccaataaaaatactccttacccttttccccaacctgatgcagagattcccatcatatttggagaatggtggacgagtgatgtcaacgaggtcttcagacaatctatggaaagtggagcagccccaagcgtatctgatgctctcactatcaatggtcaacccggggatctgttaccttgctcaagtccagaaacattcaagttaaatgtagagcaaggaaagacttatcatctccgtgttatcaacgcggcagtgaatctcattctcttcttctctgtttcccaacacaacctcactgttgttgctgctgatgctgtgtactcaaggccattcacaagggattatatttgcatatcaccgggacaagcaatggatgtattgctgcatgccaatcaagaacctggtcactattatttggctgcaagggcatattcaagtggtgttggagtagcctttgataacacaacaaccactgctagaatagagtacagtggcaattacactccaccttcatctccttcattgcctaatcttccagactttaacgacacccgtgcggcattggacttcattacaaacctaagaggcttacctgagagagcccccagtcaggtcccaaaaaacatcacaactcaaatagtgaccactatttctgttaacactttgccatgcccaaatggcagaacctgtcagggaccaaatggaaccattttcgctgctagcatgaacaacataagttttgatacccccaacattgacatactaaaagcttattactatcatatcaatggggtatttaaaccgggatttcctagatttccaccctttatatttaacttcactggggattttttgcctataacattgaacacaccaaagcaagggactagggttaatgtgttgaactatggtgcaacagttgaaattgttttccaagggacaaaccttgttggagggatagaccatcccatccatctccatggctacagtttccatgttgttggatatgggttaggcaattttaaccaaagcgtggaccccatgaatttcaatcttgttgatcctccttatttgaatacagtggttgtgcctataaatggatgggctgccattagattcgaggctgtaaaccctggagtatggtttatgcactgccatctagaacgccaccaatcttggggtatggagacagtttttattgtgaaggatggagagtctgaaaatctaagattgccaccaccaccgccagacatgcccccatgttga

SEQ ID NO: 4206 - DNA, 366 bp, Glycine Max
atgactatagttcagagtgagggggcagcaaagggaactaccacaactgagaaagcattcaaaagatggggcaggagaaccccatttttgagatatggccttcctatgatctctctcactgtccttggttctataggccttgcccaactcttgcaaggcagcaaggatattgcaaaggtgaaagatgatcaggagtgggaaataattgaaacaaaaaaagcattgtctaagactggaccagtgaatgcatacaatccaaaaaagatttccttggaggatgagctaaaggctttgcaacaaaaggtggacattaacagctatgagtacaagaaaattcctaaaccaaacaagggcaatccagactag

SEQ ID NO: 4207 - DNA, 537 bp, Glycine Max
atgactgaagaaagtgctggaaacacagttgcaacctctattaccccattcaattggtggtatctccaggcaaattctctttcttcctggaacgatactaatagcacatggagcaaccaaccaaaccctaactcttcctcttcttgtgaggaggatatatcagtctctacatctttcactaatgcttccaaccattcaagcctcaccgttgagtcctctcgcagactcattgagccacctgctccttcctccaccgagttgatgggagaacacgcatcagataatcaactttggagtcatgttttatcaggtgttggatcagacggcgagttacacaacagccaagaaattggagagaattttctggatgcactgtcatccaaaagcatgacaagcactatgtttcaaccagtgtgtgactacttgaagaaactagatcatacaagttgggagtataatggttcaacttcactaaatagctttgagaagcacttaaatgggttcagtgaggcgatgcttgagaataatgaaagataa

SEQ ID NO: 4208 - DNA, 1515 bp, Glycine Max
atgactgaagaaagtgctggaaacacagttgcaacctctattaccccattcaattggtggtatctccaggcaaattctctttcttcctggaacgatactaatagcacatggagcaaccaaccaaaccctaactcttcctcttcttgtgaggaggatatatcagtctctacatctttcactaatgcttccaaccattcaagcctcaccgttgagtcctctcgcagactcattgagccacctgctccttcctccaccgagttgatgggagaacacgcatcagataatcaactttggagtcatgttttatcaggtgttggatcagacggcgagttacacaacagccaagaaattggagagaattttctggatgcactgtcatccaaaagcatgacaagcactatgtttcaaccagtgtgtgactacttgaagaaactagatcatacaagttgggagtataatggttcaacttcactaaatagctttgagaagcacttaaatgggttcagtgaggcgatgcttgagaataatgaaaggttgaccaagttatctaatcttgtgagcacttggtctattgccccaccagacccagaagttagtagccactttgatccacaaaaaacaaacaacatgtccttgagttctaattccatggatcatcacttcccacaatttgaacacttcaagcaaccttttgaagaagcaagtagaaactctggagtgttccctaattgctatgatcatgacatgaaggtcaagcaagagtatcatgcaagtgaagtgtcaccaggatcagtatttggaaaaccattaaatgcaaatggatatcgaaatggatttaatagcctttcagtggtagatagttgcaaactctaccatgacatgcccaatatttcttcatgcacaagaaatttctcagatgttatatcctttaatagtagattgggatggccagttattggagtccatggtcaaaagcctagtatgaagtacctgaacgtatctgaaccaaagaagcaaggtcttcagacaccatcaccaccgataagaactaatgttaatggaaaaggggaggggacaacacgtgaagtaaagaagaaaagatctgaagaatcttcagatgcaatgttgaaaaagcctaagcaagatacatcaacagcttcttcttcaaaggtgcaggcacccaaagtcaagctaggggacaaaatcacagcccttcagcaaattgtgtctccatttggaaagacagatacagcatctgtgctgtttgaagcaatagggtacataaagtttcttcaagaacaagtccagctactgagcaaccctttcttgaaagctaattcacacaaggatccatggggaagcttggatagaaaagatcataaggaggacacaaagctagaccttcgaagcagaggtctgtgtttagttcctacttcatgtactcctctagtttacagagaaagcagtggaccagattactggacaccagcatacagaggatgtttgtataggtga

SEQ ID NO: 4209 - DNA, 3084 bp, Glycine Max
atgactgacatcactgatgatattgctgaggaaatctccttccagagcttcgatgatgactgcaggttgcttggtaatctcctcaatgacattctccagcgtgaagttggcaccaacttgcttgacaagatcgaaaggactcgagtccttgctcagagtggttgtaatatgaggcaggcgggtattgtaaacatggcagagatgcttgagaagcagttggcttcggagttatcaaagatgacactagaagaagctttcacccttgctcgtgccttcagccattatcttactttgatgggtatagctgagacccaccatagggttcgtaaaggagggaatatggcacaaattgcaaaatcttgcgatgatatatttaaccagctggtgcagggtggagtccccccagaagaactttatgacacagtctgcaagcaggaggttgaaattgttctcactgctcatcccacacagattaaccgtcgaaccttacagtttaaacacattagaattgctcatcttttggattacaatgatcgacctgatcttagcactgaagatcgagaaatggtgattgaagatctggtgagagagataacttcaatatggcagacagatgagcttaggcgccagaaacccactccagttgatgaagctagagctggtttcaatattgtggagcagtcactctggaaagctgtccctcattatttacgtcgtgtcagcaatgcattaaagaagcatacaggaaagccacttcctttgacttgcactcccataaagtttggatcttggatgggaggtgatagagatggaaacccaaatgtgacagcaaaggtcacaaaagatgtttcacttctatctagatggatggcgattgacctctatattcgggaagtggatagcctcagatttgagctatccatgaaccagtgcagtgataggttgtcaagattggcacatgaaattctagtccaacttcctgagtgtgtggtgatacttgagagctgtaagctaagcatgagaatcgccgtgagaattggaatcagtctgcgaatagaagtctcacacttccaacacaacttccagctagagctcatttaccttctattgctgacattccagcacctgattacatgcaatccaatcacaagaatatttgataatatatattttctaattgataggatggtggggtttctttcagcaaattccagtgcttcttcagctgcacttggtcaaaagaaattgtatgcagaatcccagacaggaaagtccacttttcaaaagcttttggagccaatgcttcctcaacttcctggaattgctccttatagaattgtcctggggaatgttaaggataagcttgagaaaagtcgtagacggttagaaattcttcttgaggatgttgcatgtgactatgatcctttggattactatgaaacatctgatcagcttttggaacctctgctcctctgttatgaatctctgcaatcgtgtggatctggggtgctagctgatggtcgacttgctgatctgattcgtagagttgctacctttggaatggtgttaatgaagcttgacttgcgtcaggaatctgggagacatgcagaagcacttgatgcaataacacagtacttagatatgggtacttacagtgaatgggatgaagaaaagaagttggacttcttaacaagagaacttaaagggaagaggcctcttgttcctgttagtatagaggttcatcctgatgttaaagaagtcttggatacattccgaattgccgctgaactggggagtgattcacttggagcttatgtgatctctatggcctcaaatgcaagtgatgtccttgcagtagagcttttacagaaggatgcacggcttgctgctattggggagttgggaaaagcatgtcctggtggaacgttgcgggttgtccctctgtttgaaactgtgaaagacctgagaggagctggttcagttatccggaaacttttatcaatagactggtaccatgaacacatcattaagaaccataatggacatcaagaggttatggttggatattctgattctggtaaagatgctggtcgctttactgctgcttgggaactttacaaagctcaggaggatgttgtagctgcttgcaatgattatggaataaaggttactctattccatggtcgtggaggcagtattggtcgtggtggtggcccaacatatctggctattcagtcccaaccccctggctctgtgatgggaacgcttcggtctactgagcagggagagatggtagaggctaagtttgggttgccacagatagctgttagacaacttgagatatacacaacagctgtactacttgcaacccttcgtccacctatcccaccccgagaagaaaaatggcgtaatgtcatggaagagatctcaaacatcagttgtcagtgttaccgcaatgtagtgtatgaaaatccagaattcctggcctacttccatgaagccacaccagaggcagaacttggcttccttaacataggtagccgccctacaagaaggaagagctcagtaggaatcggacaccttcgtgcaattccctggttatttgcatggacacaaacaagattcgttcttccagcttggcttggagtcggagcaggtttaaaaggagcttgcgagaaaggttacaccgaagagctaaaagccatgtacaaagaatggcccttctttcaaagtaccatagatcttattgagatggttttggggaaagctgacattcctatagccaagcactatgatgaagtccttgtgtcaaaggagaggcaagagcttggccatgaactaagaagtgagctcatgacagctgaaaagtttgtcatggttattagtgggcacgagaaacttcagcagaataataggagcttgaggaggctaattgagaatagacttcccttccttaatcccttgaacatgttgcaggtggagatactcaagaggttaagacgtgatgatgacaaccgtaagatcagagatgctttgcttatcaccataaatgggattgctgcagggatgaagaatacaggttga

SEQ ID NO: 4210 - DNA, 1113 bp, Glycine Max
atgagaaaaatatgcaatggccaactatttgcacacaagactcttgatgaaagccaagacgtgaggcgcaagatagtgcagcaactccttagtgacgtgcacaagagctgccaaattggtgaagcagtggatgttggaagacaagcatttaagaccacattgaatttattgtcaaacaccattttctccgaggatttggttctgtctaaaggtaccgcgggagagtttaaggacttggtgacaaatatcacaaagcttgttggatcaccaaacatggcagattatttccctgtgctgaagaggattgacccgcaaggcgcgaaaaggcaacaaactaagaatgtcgccaaggtgttggacatcttcgatggcttgattaggaaacggttgaagctgagggaaagcaaaggttctaacacgcacaatgacatgttggatgccttgctcgacatttctaaagagaacgagatgatggacaaaacgatcattgaacacctggcacatgatctgtttgttgcgggcacggatactacatcttcaacaattgaatgggcaatgacagaggtagtactcaacccagagatcatgtcaagggcaaaaaaagaactggaagaagtgataggcaaaggtaaaccagttgaagaatctgatattggtaaactcccttacttgcaagcaatcataaaagagactttccgtttgcaccccccggttcctttcttactccctagaaaggcagaaagagacgtggacttgtgtggcttcaccatcccaaaggacgcacaagttttaattaatgtgtggactattggtagggacccaaccttgtgggaaaatccaactttgttctcacctgagaggttcttggggtcaaacgttgacatcaaaggtcgaaattttgagcttgcaccctttggtgctggaaggcgcatatgccctggaatgatgctagctattaggatgttgcttttgatgttgggttctctaatcaactcctttcaatggaagcttgaagatgaaattaaaccacaagatgtggacatgggagaaaaatttggaattaccttacaaaaggctcaatcccttagacctcttgcgtgcctttttatttga

SEQ ID NO: 4211 - DNA, 201 bp, Glycine Max
atgagaatatcccatcctctagtcaaactcattcgaaatcttgctcaccaacaatggagcatctcttttaggcatgtcctccgtgaaggaaattcaagcgcagataggttaacgagatatgattctacttatgaggattccttttatgtttggaacaactgccctatcatcttgcctctctggtcttggctgattcgctag

SEQ ID NO: 4212 - DNA, 1734 bp, Glycine Max
atgagaatggctttgaatattgccacaaggcttcttgttcctgtggtgcatcacggacccagtttgacttgtgtcaggggtttttcattctcacagtcaccaacccttgttcttcctctccactctcaccgtcccgccaaaaccctcctacaaatcgccacgacgccgtcgtttcggagttgtggctgcgcaccaatgtccacgttccaggttcgcgacaaaatcgacctctccgacgtcgagagaagaatcttcgacaggcttctcgccactcttcgccacttcgacctccaaactcagctccgagtcgccggtggctgggtccgcgacaagcttctgggaaaagagtgctatgacattgatatcgcgcttgacaatatgatgggaaccgagtttgtggataaggtgagggagtacttgttgtccattggcgaagatgcacagggagtttgcgttatcgagagcaatcctgatcagtccaaacatttggaaacagccaggatgcgtttgtttgatatatggattgattttgttaacctaaggagtgaagaatacgctgagaatagccgcattccttctaagcaaagatttggcacagcagaagaggatgcatataggagggatttgacaattaacagcttgttctaccatatcaacactgactcagttgaagatttcaccaagagaggcatctcggatcttaagtctggaaagatagtgactcctttacctccaaaggccacatttcttgatgatccattacgagttcttcgagcaattagatttggtgctagatttgaatttactctagatgaagatctgaaagtagctgctgcatgtgatgatgtgaaagatgctctagctgctaaaattagcagagagcgcattggaactgagattgatctgatgatatccggaaatcaacctgtcaaagctatgacttatatttgtgatcttacactattttggattgtattcagtcttcctcctgaatttgaaccttacatttcagatgggtgtgaaaggctttgcatttcttacttggatactgcatggaaccttatccatttacttggagagtcaacttttactgctgaacaaaaaaggttaacactttgtgctgctttgtttctccctcttagaaataccacttacagagaaaagaaagctaagaagattcctgttgttaatcatattatccgggaatctctcaagcggaaagctaaggatgcggaaatggtgcttaacttacaccaagcgtcacataaatttttgtcattgatcccttgtcttgcatctagtgaggatgtccaagttgttgatcatgattggctgggagacttagtggatgtccctgtctcttctagagtccgggtactaacagggtttctcttaagagagcttaaagattattggcatgttgctctgttgatatccactatactacatcccattgacattaaggatgaaccatcacagttgggcaaacgaagagatctgtttaatactgtggagaattctataatcaaactaggccttgagaaagtatgggacataaaacaattgatcaatggcaaagatgttatgaatgccctacagctaaaaggaggacctcttgttaaggagtcgctggataaagcaatggcttggcaacttgcctatccatctggaactgcagaggaatgcatcgaatggttgagagaagccaattctaagcgtattaagttgcagtga

SEQ ID NO: 4213 - DNA, 369 bp, Glycine Max
atgagacttataacacataacatgctgtcatcgaacataaagggtgtggtgaatggatttcctttgcgcattgaagcagagaaagtgatggaaaagaccatggaaatgaacagtgagtttctggaaaagatgtttgagaaggttgattggaaggcttttgttgatgcatcgcgggcaatgggatatactgaactacctgaggaggccaactcttccatgctagattctgatgaatttctgaacaggtttcaccatgctctcttggaactcgaccttgaagaaggtgcccttgtttgccctgagactggacgacgttttccagtcagcaagggcattccgaatatgcttcttcatgaggacgaagtctga

SEQ ID NO: 4214 - DNA, 1578 bp, Glycine Max
atgagattcatatgttctaatattcataatgatgtatcgaaaggactgcaaagagaatatcatgtttattttgtccctcgccgcactgttgtttgtgagaaagttcttgaggaagagaaattacataacatggttacaataggggaatatcccttgtatagtgtaccaatggatgaggatgtattatcatttgaacttgatctctcttacaaagaatgccaagttgatggtgatacaagctcactttggcacattgctaaagccattcacaaacttgagttttcttttggagtgataccaaatgtgagggcaaaaggaaaagcatctgtgcgtgttgcagacatcctaaaccgaatgcaagctgaggaaccagttaactcatctgatatggttgtgccagagataaatacagtaatccttttagatagagaggtggacatggttactcctttgtgttcccaattaacatatgaggggctacttgacgaggcaaatttggttgtgttgttatttgatcaggcttttctttttgagaatatcccttttctgcacatcaacaatggttctgtagagcttgatgcatctattatgggtcttcagcaagaagggaagaaaactaaagttccacttaattcaagtgacaagctttttaaggagatacgagatctcaactttgaagttgttgtccagattttgcgccaaaaagctacttccatgaagcaagactacacagaaatgacaactactacgcagacagtttccgagttgaaggactttgtgaaaaagctgaactcattgccagagatgaccaggcacataaatcttgctcagcatctatcaacattcacatcaaagccttcatttcttgggcaacttgatatggaacatacaattgtagaggcccagagttatgatatatgctttgagtatattgaagaactgatccataagcaggagcctttgacaacagtcttacgccttctaatcctattttcgattactaattctgggttgccaaagaagcattttgactacttcaggagagaactactccacagctatggatttgagcacatagcaatgctaaacaatttagagaaagctggactttttaaaaagcaggagtcaaaaagcaattggcttactataaaacgtgctctacagcttgtggttgaagacactgatacggccaaccccaatgatattgcttatgtcttctctggatatgcaccactcagcattcgactggtccagcatgccattcgatctggatggcgtcctgttgaagaaattttgaagctactgcctggacctcatttggaaatgaagaggggtggattctcaaatagcccatcatttgacactttatcagggattcaatccagcatagccaaagtacctgatggaaggcgtgctgtggtgcttgttgtctttgttgggggcgttacctttgcagagatttctgcacttcgatttttatgtactcaggagggaatggcatatgatttgattattgcaacaacaaaaatagtcaatggccaaaccttggttgaaacgtttatggaaaagctaggttga

SEQ ID NO: 4215 - DNA, 1611 bp, Glycine Max
atgagcaaagttcttcaggcgaagttggaggcaactccaacatgggctgttgcagttgtgtgctttgtgatgcttgctatttcaatcctcattgaacatattcttgaagaacttggaaagtggttaaaaaagaaacacaaaaaggctcttcatgaagcgctggaaaaggttaaaggagagcttatgctgctgggattcatatcgttgctcctagtgatgtttcaagatcacatttctaatatatgcatcccaaaaagcggtaaagaccaagtagcttttatgtctgaatatagtattcaccagctccatatattcgtctttgtgcttgctatttttcacatcctacagtgcatcatgacactgactttgggtagaaccaagatgtctatatggaggaagtgggaagacgaaacaaagagtcttggccatcagttccaccatgatcctgagaggttcaggtttgctagggatacaacgtttggacgaaggcacttgagctcatggagtcgatcaccaggttccttatggatagttagcttcttccgacaattctacgggtcacttaataaagtagactacatggcattgcggcatggattcctcgtggcacatttgactccagcaaatgaggcaaaatttgatttccagaactatatcaagagaacacttgatgaggattttgcagctgtggtgggcataactccaaccatatggttctttgctgtgctaattctgctcacaaatactcatgggtggtattcttatttttggattccatttatcccagtaattataatcttgttggtgggaacaaagctacaaatgatcataacagagatggcactaaagattcaagataggggggaagtggtcaagggtgcacctttggttgagcccggagatgaattgttctggttcaatcgaccccgcctcatcctctttttgattcatcttgttctctttcagaatgcatttcaactagcgttttttgcttggagcacatatgacaatgggttcaaaataaactcttgtttccacaaaactactgcagatattgtcattagacttacaatgggggttctcacacaagttctatgcagttatgtgactttgcctctttatgctctagtcacccagatgggttctaccatgaaagttactattttcaatgaaaatgttgcagtagccctgaagaactggcatcacactgctaaaaagcacatcaaacacaacaaggattctacttcaaatacaccattctcaagcaggccaggaaccccgacacatggcatgtctccagttcacttgcttcacaagcaccctagacacagtgacagtccagtagtttctccaagggcatacaattacgaaaatgaacagtggggtgttgaagggatacattccccaagccaccacgcaagagatcatgatcctgatcatgaaaagaccatgcagatgcagatgcagatgcagcagcagcggccagctccaacagcagaattgcctcctagtggactcaatcctattcgaactcaacatgaaatcaacattgctttatctgaattttcatttgggaggggacaccacactggtagtaatactaataactaa

SEQ ID NO: 4216 - DNA, 930 bp, Glycine Max
atgagcacgccaccgctgtcggtgtcgctctcgcagtgtacgaggttgtttggcgcgtctggtttcacgcgcctctgcaagggtctctctctggtcctcatttctcttcacattctccttcacctcttcccttccgctatcacctgcctcgccctcattcccgccaggactattccctttgcctggaacctcattacagctggttatgttgaacaatctgtctatggggtagtggtcagcacaattggtcttctcttcattgggaagctgcttgagccagtttggggtcccagggaatttctaaagttcatctttatagttaactttctaacttctctctgcattttcatcactgctattgctttgtactgcattacagggcaggagagttacctttatatgccattctctggatttcatggagttatatttggcttcttggttggcatcaagcaaattgtaccagatcaagagcttcctttcctcaagataaaagtgaagtggttgccatctattgctctattgtgttctattgctacgagcttctggtcactagaggcagcatcatatcttccaactgtaatatatggtacatatatgagctggatttacctcagatactggcagaggaaaccagaaacaaaactcaagggtgacccaagtgaggattttgcattctctacttttttccctgagtttttaagaccggttatagaccctattgcatcaatatttcatcgaatgctctgtggaagattagatgcttctaatgatgctcaaggttacactctaagaggtgaacctttgccaggttctgaccccattgaagcatctaggagacgagaaagaggtgctcgagcactggaagagaggttggctactgcacctagtgcaggggagttagaaacagatgctacagaaattgtttga

SEQ ID NO: 4217 - DNA, 507 bp, Glycine Max
atgagcggaacggtgaagaaagtaaccgatgtagcattcaaggtgggaaggaacatcgattgggatggaatggcgaagcttctcgtctccgatgaggctcgcagggagttctccaatctccgtcgcgctttcgacgaggttaactcccaactcgaaaccaagttcagccaggaacctgaacccatagactgggattactatagaaaaggaattggcactcgcttggtggatatgtacaaggagcattatgagagcattgaggtccccaagtttgttgacacagtaactcctcaatacaagactaaatttgatgccctattgattgagcttaaagaagcagaggagaaatctctgaaggagtctgagcgtttggaaaaggaaattgttgaagtacaagagttgaagaaaaagctcagtaccatgacggcagatgagtactttgaaaaacatcctgagctgaggaagaagtttgatgatgagatcagaaatgataactggggctattga

SEQ ID NO: 4218 - DNA, 891 bp, Glycine Max
atgagcgtgttttggcaggaaggtggtatggcgaaggacgttgaggttgctgagcgtggctccttctctgggaaggactaccaggaccctccaccagcaccactcattgatgctgaggagctcacaaagtggtccttttacagggctctcattgctgaattcattgccactttgctcttcctctacattactgtgctcacagtcatagggtacaatcaccagactgacctcaaggaaaatggtgaaatctgtggtggggttggcattcttggcattgcatgggcctttggtggcatgatcttcatccttgtctactgcactgctgggatttcagggggtcacattaacccagcggtgacatttgggctgtttttggctcgcaaggtgtctttgatccgagccatcatgtacatggtggctcagtgcttaggtgctatctgtggagttggtttggttaaggctttccaaaagtcttacttcaacaagtatggtggtggggctaattccctcgctgctgggtacagcacaggtactggattgggtgctgagattattggaacctttgttttggtctacactgtcttctctgccactgaccccaagaggaatgccagagattcccatgtgccggttttggctccacttcccattggatttgctgtgttcatggttcacttggccaccatcccagtcactggtactggtatcaaccctgctaggagtcttggagctgctgttatctacaaccaagataagccatgggatgaccattggatcttttgggtaggaccatttattggggcagccattgcagccttctaccatcagttcatcttaagagcaggtgcagctaaggctcttggatcattcaggagtaacccccataattga

SEQ ID NO: 4219 - DNA, 1302 bp, Glycine Max
atgaggatgaagagggttttcgttgtttacagtgttttgttgctgctggtccagttttggcttggtgaggctgagacattctcggtggatggaaaggttttggttttggacgaatccaacttcgattccgccatagcctccttcgatcacatcttggttgacttttacgctccctggtgtggccactgcaagcgtctctctcccgagttagatgcagccgcccctgtacttgcaaccttgaaggaacccataatcatagcaaaagtagatgcagacaagcatacccgccttgcgaaaaaatatgatgttgatgcatatccgaccattttgctgtttaatcatggcgtccccacagaataccgtggaccaaggaaggcagatttacttgttcgttatctgaagaaattttctgcttctgatgtttccattctggattcagattctgctgtgaatatgttcgttgaagaagcaggcacttttttcccgatttatataggttttggtttgaacagttcggtactagaaaagtttggcataaagtacaagaaaaatgcatggttttctgtggcaaaggatttttcagaggatctcatggtattgcatgactttgataagattcctgccttggtttccctgaatccacagtacaatgagcggaacacattctatggaccctttgaagaggattttttagaagattttgtaagacaaaacctgattcctttggctgtgcctgtatcctatgaaacactcaagttgatgaaagcagatggaaggaaaatagttttgacaattgttgaggatgaagatgaagaaacaacaagagagctgattaagttattgaaggctgcggcatctgcaaatcgtgacttaatatttggttacgttggagttaaacagatggaagaatttgctgaaaattttgatattgatactaaactaccaaaaatggtcatttgggataaaagtgatgattacctttcagttgttgattcagaaaccatagagggggaggaccaaggaactcaaatcactaaatttctcgaaggatacagggaaggaagaaccataaagaaaacatttagtggcccttcactaatgcgattcatccatcgatcctttgacattagaatggtgtacatcattgtttttgtggtggcagtactgatgctaattcagacattcagtaaaggaggtgatgaataccagagtgtacccaatcaagttcaaactgatcatgcaatcagttctgtttctgaagctgaaaacaatgagtataaacctggtgacaaggaagactaa

SEQ ID NO: 4220 - DNA, 2796 bp, Glycine Max
atgaggcagaggcgtgaaactgcttcagcttcatctaaaggatcaagcagtggcgaagcaagcgaagaagagtcaagtagtaatggtgctgaaatccgcaccactgcttatgttggaaacccaaggaggtcttcatttgtgtggctggccttgttgctaatcatcacttattgctgttcatccatttatcattatcagtttcagagcatgcctgtgcctcttactgcagaagaggccggcaagagggggttttcggagattgaagcattcaaacatgtcagggccttgactcaggtggggcctcatcctgttggttctgaagctctgcatcttgctctgcagagtaatccattttctgttaattattatacatttattttgactagcttccaactgcagtatgtcttgacagcatgtgaaaatattaagaaaacagctctctgggaggtagatgttgaagtggatctttttcatgcaaagtctggtgcaaatcatctgcgcagtggcttattttcagggagaacacttgtttattcggatctaaatcatgttgtagtaagaatcttgccgaaatatgtatctgaagcaagggggcaatctattctggtctcttctcatattgatactgttatttctacagcaggggctggagattgtagttcatgtgtaggtgttatgctggaacttgctcgtggaatttctcaatgggctcatggattgaagagagctattatattcttatttaatacaggtgaggaggagggtctcaatggtgctcatagcttcataacccagcatccttggagcaaaactgttcgtgtggctattgatttggaggccatgggcattggagggaagtctactatttttcaggctggtcctcatccttgggctattgagaactttgctttggtagcaaaatatccatctggtcaagttattgcacaggatctgttttcttctggggccataaaatctgcaactgatttccaagtgtacaaagaggttgctggcctttctgggcttgactttgcatatttggataacacggctgtctatcataccaagaatgacaaattagagcttttgaagactggatctcttcaacatctgggggaaaatatgcttgctttcctgcttcatattggggcatcttctcatattccagaaggcaattcaactgaatcagaggaagatataagcaagaacaatgccatttactttgacattttgggaatgtatatggttgtataccgtcaaaagtttgctaatatgctgcacaattcagtaataatgcagtcacttctaatatgggttacatcattggttatgggtggtataccagctgcagcttcattggccttgtcgtgtttgagtgttctcctcatgtgggtctttgccttaagtttctccttccttgtttcatttctcctacctttgatatcttcatctccagtaccatatgtttcaagcccaatgttggtggttggattatttggtgcaccagcttttctcggagcattgactggtcaacattttggttttcttctacttcaaaaatatctttcgaatacactatcaaagggaaggcagttgacccccattattaaagcagctgttgtcaaaatggaggctgaaagatggctctataaagctggatcctttcaatggcttatacttctcattttgggaaactattttaaaattggctcttcttacttggctcttgtttggttagtttctccggcatttgcatatggtttttttgaagcaacactaaccccagccaggctaccaaagccactcaaactggcaaccataattctggggttagccactccgattttattttctgcaggcatatttattcggctggctgctacacttatagggggtatggttcgatttgataggaatcctggtggtactcctgaatggctaggaaattttgtgattgctgcttttattgcttctcttttatccttgaccttggtgtaccttctttcatatgtccatctttcaggtgcaaaaagggcaatcatcctagctactttggtgctatttagtttatcacttgcagttgtattaacaggtgttgttccaccattttccgaagacactgctagagctgtgaatgttgtacatgttgtggatgccacaggaaaacttgatcaaggacagaatccaatatcatatgtatctttattttctaatactcctggaaatttgaacaaggaggttaaacagattgatgaaggttttgtatgtggtagagacaaaacagttgattttgtgactttctcggttaaatatggttgttggacctataatgacaccactaatgactggactgagatggatattcctacaatgaatgttgttagtgatgctaaaggaaatggaagaattacacaagtttcaatcaatacaaagggttctatccgttgggttcttgcaatcaatatagaagaaatagaagatttcgagtttaaagatgcaaggaattctgaagaattgatttcagttgacaaaaagagtagtgtggatggttggcacattattcagttttctggaggaaaaaatgcaccaacattgtttgatctgactctttactggaggtcaggttcaactcataactctgatagtcctcttctgaaactaaggactgatgtgaacagattaacaccaataaccgaacgagtccttgagaagcttcctcgttggtgttctttgtttggcaaatccacctctccttacaccttggctttcttgacaaatctgcctgttaaattttag

SEQ ID NO: 4221 - DNA, 2841 bp, Glycine Max
atgagggaaacaagatcagcacctgcacctcaaaaatttgtggcttcaaaatttgaaaaagaaggttctgcagtgggtagaaaggggcttacctacctacagtcattccctcgtggcatggaatgtgttgatccactggggttggggatcatagacaacagaacgctaaggttgatcactgagtctgcacatagttctcccaagactgacaaggatattcaggatggcaacttacgtgaaaaattgctgtatttttcggagaacttcgatgcaaagatgttcttatcacggatacacagtaataccagtgctgccgatctggaggctggtgcacttgctttgaaaactgatttcaaaagtcgtactgagcagagaaagcagttggttaaggacaactttgattgctttgtctcttgcaaaacaacaattgatgatattgagtcaaagttaagacaaattgaggatgaccctgaagggtctgggacttcccatttgtttaatattattcaggatgttagtttgcaggctaatcgtgccttgaagcctttatttgagagacaggctcaagcagaaaaaattaggactgtccaaggtatgctacagaggtttcgaacacttttcaacctaccaagtactatccgaggcagcattagcaagggtgaatatgatttggcagtcagggagtacaagaaggccaaatcgattgttctgccctcccatgtaggtatcctaaaacgtgttcttgaagaggttgagaaagtgatgaatgacttcaagactatgcttttcaagtctatggaagatccacaaatagatccaacaaaccttgagaatactgtgaggttactgttggatttggagccggagtcagatccagtgtggcattatttgaatattcagaatcagagaatttgtggtctgcttgagaagtgtactttagaccatgaggccagaatggaaaatttgcataatgagttgcgcgaaagggctctttctgatgccagatggaggcagattcaagaagatatgaatgaatctgtaggtgtaaagtttatgtctcatccatcagatctaactggtgaagaggttgatggtttaagaggaaggtatatccacagattaactgctgtaatcatccattatataccagccttctggaaggttgcactctctgttttcagtggaaaatttgccaagtcttcccaagttcccactgattcaaattccaacagttctgcaaataaaattgaagaaaaagctggagatgggaaatactcaagccattctcttgatgaagttgctgcaatgatatgcagcacaatatcactgtatggagtcaaggttactagcatttttcatgatctagaggaatcaaatgtcctccaattctacatgagtgaggccatagaagatatatctaaagcatgtgcaactttggaattgaaggaagctgctcctccgattgctgttgcatctatccgaactctgcaatcagagattataaagatttacatactgaggctttgctcttggatgcgggcatcggttgaagaggtttcaaaggatgtgacatgggttattgtttcaattcttgaaaggaacaaatccccatatgcaatctcattcttgcctttaacattccgttcagttgtagcctcagcaatggatcaaatcaattcgatgcttcggtccttaaggaatgaggcaacaaagtcagaggatatgtttatgcaacttcaagaaattcaagaatctgtcagacttgcatttttaaattgcttcctggattttgctggtagtttagagcgtattggatttgaacttggccaacatagatcagacgaagagggctcccagttaccaaatggatatacacatgaattggaaaatgcaccttctggtcttcgtggaggtgttattgatccccatcaacagttattgattgttctaagcaatattggatattgcaaaaatgaactttcttgtgagttgtatgacaaatatagacacatctggcagcattccagggggaaggatgaagggaacagtgatttagaatatcttgtgaatagtttctcagcgcttgaagcgaaggtccttgaacaatatacttttgcaaaggcaaacttgatcagatctgctgccatgaattatctgctgcattctggcattcagtggggagcagcacctgcagttaaaggtgttcgggatgcagcagtagagttgctgcacacattggtagctgtgcatgcagaggtttttgctggtgctaagcctctcttggataaaacgcttggcattcttgtggaaggcttgattgacacatttatcagcatttttcatgaaaatgaagctacagatcttagtgcacttgatacaaatggattctgtcagctcatgcttgagcttgagtacttcgagaccatattaaatccatattttacttctgatgcaagagattccttgaagtctttgcaaggattacttttggaaaaagccacggagagtgtgactgatgctgttgacaatccaggacacaatcgtcggccaactcgtggtagtgaagatgcacttgcagatgataagcaacaaggaacaactgtgtcacctgatgagctcatttctcttgcacagcagtacagctccgagttccttcaatcagagcttgagaggacacgcattaacacagcatgctttgcggaatcttttcctttggactctgtgccagaaccagccaaatctgcctactctcccttcaggaactcaatggattctcctagcagaaaccacagaggtacctacaataccggagcctcaagcttctctcggcatagacattga

SEQ ID NO: 4222 - DNA, 1181 bp, Glycine Max
atgagggagcagatgctgagacaagaccataggaggaaaggtgttgtggaagatggcaatggcctccctttgatccatttgttgctctcaaccgcaacttcagttgatgacaacaacatggactcatccttagagaatctcactgatttataccaaaccgtttccgtaactggtgactcggttcaacgtgttgtggcctatttcgttgatggtttggcagcaaggcttctcacaaagaaatctccattctatgacatgctcatggaggaacctacaaccgaagaagagtttcttgcattcacggatctctacagggtttcaccttacttccaatttgcacatttcacagcaaaccaagccattttggaggcctttgagaaagaggaagagaggaacaaccgtgctttgcatgtcattgactttgatgtctcctatggcttccaatggccctctctcattcaatctctttcagaaaaagcaacaagtggaaaccgcatatccctgaggataactggttttgggaagagtctcaaggagcttcaagaaaccgagtctaggttggttagtttctcaaagggttttggaagcctcgtgtttgagtttcaagggcttctaagaggctcaagggtcatcaacctaaggaagaaaaagaacgagaccgtggctgtcaacttggtttcttatttgaacactttgagttgtttcatgaagatctctgacacattgggatttgttcattcccttaacccctccattgttgtggtggtggagcaagaaggtagcaggagtcctaggagcttcttgtcgaggttcacagactccttgcactactttgcagccatgtttgattcacttgatgattgtcttccacttgagagtgctgagaggttgagaattgagaagaagcttttggggaaagagatcaaaagcatgctcaacaatgatgtggatggtggtgtggattgccccaagtatgagaggatggaagcatggaaggctagaatggagaatcatgggtttgttgccacaaaaataagctcaaagtctatgatccaagcaaaactgttgctgaagatgaggactcatttttgtcctcttcagtttgaggaagagggaggtgggggtttcagggtttctgaaagagatgaaggaagggctatctctttagggtggcaaaatag

SEQ ID NO: 4223 - DNA, 1683 bp, Glycine Max
atgagggaggaagaagtggcggaaagcataacctcaattcttgttcttcagaagaagaaaaagaacggtggaggagtggaatcagagaaactagaatccttcatcccacacctcactctccctctcatcctctccatcctctcacgcaagcccctcaactccgaccccgccgcgctcctctccttcttccggtggctccaaacccacgcgccgccgtccctctgctcctcccctgacctcctcctctccctcctccctcccctcctcgcccgccgcaagttctccgacgccaagtccctcctcctctccttcatctcctccgaccaccgccacgccctccactccctcctcctccgccccaaccccgccctctccaaacccctcctcgacacctccctcgccgcctacgggaagattgatgaggcgattagggttagagacgagatggagagtttgaagttgattccggatgttgttacttataatactttgattgatgggtgttttaagtggcgtggcagcacggaggggtttaggttgttggaggaaatgaagtcgagggggggtgttgagccgaatgcggtgactcacaatataatggttaagtggttcggtaaggaaggtaagatcaatgaagcgagtgatgctgtggtgaagatggtcgagagtggggtttctcccgattgttttacttataatactatgattaatggtttttgtaaagctgggaagctgggagaggcatttaggatgatggatgagatggcaaggaaggggttgaaaccagatatttgtactcttaacaccatgttacacactttgtgtatggagaagaagcctgaagaggcatatgagttgactgtgaaggccaggaagcgaggttatattcttgatgaggtgacctatggaactctgatcatgggatactttaagggtaagcaagaagacaaagctttgaagctttgggaagagatgaagaagagagggattgttcctagtgttgtcagttataaccctctaatcagagggttatgcctgtctgggaaaactgaccaagcagtggataaattgaatgagcttttggagaagggtttggtccctgatgaggtttcatgtaacataattattcatggttactgctgggagggaatggtggataaagcatttcagttccataacaaaatggtagggaactcattcaaaccagatatctttacacgtaacattctccttcgaggactttgcagagtggacatgctggagaaagcttttaaactctttaactcatggatctctaaacagaattctgttgatgtagttacatacaacacaatgatttcatacctttgcaaagaagggagattggacgaagcgtttgatcttatgactgatatggaggttaaaaaatttgagcctgaccagtatacttacaatgccattgttagggcacttactcatgctggtaggaccgaggaagcagagaaattcatgtcaaaactttcagagacagggcaagctcaaataagtgatttgtgtacccaggggaagtacaaggaggcaatgaaactatttcaagagtcagaacagaagggagttagtttaaataaatatacatatatcaagctaatggatgggtttttgaagaggcgcaaaagcatatcgaaagttgaccatgcaaattga

SEQ ID NO: 4224 - DNA, 291 bp, Glycine Max
atgagtagcaaagggttgctgagaggagcttcgttaactgcaaacgcagtgtggcatagaagcagtttcttcccaaaggttgaagaaattgctcccaaaattcaacaagttatagaatgcttgctacttggctttcacgtaacataccaggttttcccaattcaacgtaaaggtgcaatgggtatcgagaaggctcaaatcaacattgtggtggttggttatgtggactctaagaagttaaggaactcaataagcctgttgctgagagacaaattgctgtcattaacttaa

SEQ ID NO: 4225 - DNA, 111 bp, Glycine Max
atgagtagtacagtgaaaccaataaacttaatccatatccaaaatgctgcacaaaatcagatgcataaactactaaaacaatgccctgttcagcattttattcacatgtga

SEQ ID NO: 4226 - DNA, 1062 bp, Glycine Max
atgatacaggaagatcaaggacagtgttcttctcaagcgatcaataactaccaccaagcctatcaagagcagcttctccttcagcaacagatgcaacaacaacaacaaaacaatgatatctttggtggaggaggaggattgaacatgtaccctggtgctgaagtttctccaatcatgaatcatcatcatcaaccatggtctatgactatgccacatcatcatcaccatcatcaggttcatgacccttttcttgtccctccccaaccttcaccctatgcaagcttgttcaacagaagaggtccttctcttcatcagtttgcatatgatcatcatggttcatcttctgaccatcttaggatcatatctgaatcccttgttggaccggtggttcaacccggttcagcagtaccctttggcctccaaaccgagttggctaagatgactgctcaagaaatcatggaggctaaggcccttgcagcttcgaagagtcacagtgaagctgaaaggagacgcagggagagaatcaataaccatcttgctaagctccgcagcttgttgcctagcacaaccaaaacagataaagcatcattgctagcagaagtgattcaacatgtaaaggagctgaagcgtcaaacctcggtgatagcagaaacgagtccggttccgaccgaagctgatgagttaacagtggtagacgaagccgatgaagatggaaactctgtgatcaaagcctcattgtgctgcgaagataggtcagatctgttccctgaactaatcaagacattgaaagcgttgaggctaagaacccttaaggctgagataacaacgcttggtgggcgcgtcaagaacgtgttgttcatcactggagaagaagcagattcaagcagtggcagcactgaggaccatagccaccaccaccaccaacaacaacaacaacagtactgcattaactcaatacaagaagctcttaaggctgtgatggagaagagcgttggggatcatcatgagtctgcttctgccaatattaagaggcaaaggaccaatataatatcaatgtcctag

SEQ ID NO: 4227 - DNA, 546 bp, Glycine Max
atgatgactctcgaggacttcctcgccaaggccgacgccgtggacgacgctgaccatgaccatgaccatgcccatgaccacgaccccgactaccacaacgacgacgtcaagatgccaatgcccctcaccgagaggctcggcagcggcaccctcttctccttcgaccaccttcccacgacgccgtttcacgacccctccgaaggctccgtcatagggttcggaaacggcgtcgaggtcatcgaatgcggaaggggtaaaagatcgcgtcccgttttggagcagttggataaggccgcgcaacagaggcagaggaggatgatcaaaaacagagaatctgctgctaggtctagggaacgcaaacaggcttaccaagtggaattggagtctttggcggtgaaactagaggaggaaaatgacaagctcttgaaggaaaaggctgagaggaaaaagaagaggtacaagcagctaatggaaaaagtactccctattgcgcagaagcaaaagccaccatgtatactccgtagggctcgctccttgcaatggtag

SEQ ID NO: 4228 - DNA, 2055 bp, Glycine Max
atgatgccccctgagcaagaaaccactaatattgcaccaaaagttccagccatcacaacccgacaagagaccagctcgatccaccatgattcagagggttcaaacactaacaaaatcaaaccaagtttagaattggatgataattgcattcctgcgcagcaacagactcagccaacaccaccaccaccaacaacatcaagattttccgttcttcaccaatccttgcgccccattaccctcaaatttgaagacgtatcttacaccataaccttcgaaagccaaaagaagaagggttgcgtcttacgtaaagaatcaaagctaagaagaaaagtcctaaccggagtaaccggagtagtgaaccccggagagttaacggcaatgctgggtccctccggcagcggcaagacgaccctcttgaccgccctggccggaagactcgccggaaaagtctccggcaccataacctacaacggccaaaccgaccccaccttcgtgaaacgcaaggtagggttcgttccccaagacgacgttcactaccctcacctcacagtgttagagactttaacctacgcagcgttattgagacttccgaagagtttgagcagagaagagaagaaggagcacgcggagatggtgattgcggagctagggctaacacggtgtcgtaacagccccgttggagggtgcatggctctgttccgtggcatttcgggtggggaacggaaacgggtcagtatcgggcaggagatgttggtcaacccgagtttattgtttgttgatgagcccacctcgggtttggactccaccacggcccaacttatcgtgtcggtgctccatggactcgcccgggcgggtcggaccgtcgtcgccaccatccaccagccctccagccgattgtataggatgtttgataaggtcatcgtgttgtcggacgggcacccaatttatagcgggcatgcgggtcgggtcatggactatctcggatccgttggatatgtcccagctttcaacttcatgaacccggcagatttcctgcttgaccttgctaatggcgtagttgctgatgtcaaacatgatgatcaaatagaccaccatgaggatcaagcttcagtcaaacagtccctaatttcatcgtttaagaagaacttatatcctgctcttaaagaagacattcaccaaaataacagtcatccgtcagcttttacatcaggaacacctagacgctctgataaccaatggacctctagctggtgggagcaattcagggtgcttcttaagaggggtttacaagagaggaggcatgaatctttttctggcttaaggattttccaagtcttgtctgtatccattctctcaggacttctgtggtggcactctgatcctgcccatgtacaagatcaggtgggactccttttcttcttctccatcttttggggattcttccctctcttcaatgccatctttgccttccctctggagaggccaatgttaataaaagaaagatcatcagggatgtacaaactctcctcatactatgttgctaggatggtgggagatttaccaatggagctagtgcttcctaccatctttgtaactatctcctactggatgggtggtctcaagccttcattggtcacatttgtgctaaccctcttgatcatgcttttcaatgttttagtctctcaaggcataggcctagcacttggggccattctcatggatgtgaagcaggccacaacactagcttcagtgaccatgttggtgtttctcttggctggtggctactacattcagcaaatgccggcttttatagcttggttgaagtacatttctttcagccactactgctataagctactagtaggagtacagtattcagtaaatgaggtatacgaatgtggaccagggttgcattgtagggtaagagattttcctgccataaagtgtatggggcttgatgatactatgtggggagatgtggctgcattgactgtaatgttgattggatacagagttgtggcatatctagccttgaggatggggcagcctcactga

SEQ ID NO: 4229 - DNA, 1059 bp, Glycine Max
atgatggctggtgttagtggcagtagcactactcccttattgtgctctttgttctttatttcttccttactttttgcttcctgcacccatgcctcctcccaggcacctcctccaattgtggatggactttcatgggatttctataggacgagctgtcccatgcttgaagggatagtgagcaagcatctccagaaggtgttcaagaaggacaatggtcaagctcctgccttactcaggatcttcttccatgactgctttgttcagggttgcgatgggtcgatattgttggatggaagtccaaatgaaaaggatcaaccggcaaacatagggataaggccagaggctttgcagaccattgaaaatcttcgatctcttgttcacaagcagtgtggaagggtcgtctcttgcgctgacctcgttgttctagccgcacgcgatgctgtttctctgtcaggggggccaatatttcccgtgccactgggaagaaaagatggtctaactttcagcatagacggcacaggaaaccttccgggaccgtcttcccgaaccggccagctcctcgacagatttgccggcagaaacttcgacgccaccgacgtggtcgcgctctccggcgctcacaccttcggacgggcccactgcgccacattcttcagccgcatcaaccagacggacccacccatcgaccctaccttgaacaacaacctcatcaaaacttgtccctcttcccagtcccccaacacggccgtgcttgacgtgagaacccccaacgtgttcgacaacaagtactacgttaacctcgccaaccgacagggtctgtttacctcggaccaggacctgttcggtgatgcccggactaagggaatagttaactcctttgctgaaaaccagaaactgttctttgaaaagttttcaaatgctgttgttaagttgagtcagttggatgtgttgaccgggaaacaaggacagattcgcgccaaatgctccgtccccaacaagaagaaggtggtcacctctgtggtggaagaagagggagtggatttaagcgctcagatgtga

SEQ ID NO: 4230 - DNA, 492 bp, Glycine Max
atgatgggtgtgggagcagtgaagcaagacatcaaagttatgatcctaacagggtttgcagggctagttgctggggcatgcagcatggccataggtgagtttgtgtcggtgtattcgcaattggacatagaagttgctcaaatgaaaagagagaaagaaagggacagtatagatcaagatcaggaagatgatgatggtgatgagaaagagaaattgccaaaccctatgcatgctgcagcagcatcagctcttgcattttcagttggtgcaatggtgcctctccttgcagcctctttcataagggactataaggtgaggctaggtgtggttttgggagcagtgagtttagctcttgtggtgtttggttggttgggggcagtgttgggtaaggctccaacatttaggtctattgtgagagtcttgcttgggggttggctagccatggctattacttttgggctaaccaagttaattgggtcaagtggtctttag

SEQ ID NO: 4231 - DNA, 1383 bp, Glycine Max
atgatgggttatccttcaagactctatcttgttttgcttttgtccatttgtggggtggtttctttagcttccccaattgaagatcagaagagagatagaattactcagcttccagggcagccaaagaatgtgggatttgctcagtattcaggttatgtgactgtgaatgagcaaagtggaagatcacttttttactggttggtggaggcaccagtgaagcgtggaccaaagtcaaggccactagtgttgtggctcaatggtggtccaggatgttcctctattgcttatggtgcatctgaggaaattggtccttttcacattaggcctgatggcaagtcactttacttgaacccttatgcttggaacaatttggcaaatgtactgttccttgattctcctgctggtgttggcttttcatattccaataagtcaacagatctgtatacatttggtgaccagaaaacagctgaagatgcatatacttttcttgttaattggtttgaaagatttcctcaatataagcatagagaattctacattgctggagaaagttatgcaggtcactatgttccccagttgggtcaaattgtttacgagaaaaataagggaatcaagaatccagttataaattttaagggatttatggttggtaatgctgttactgatgattatcatgattatattggcacatttgaatattggtggacccatggtttggtttcagattccacgtataggatgctaagaattgcctgcaattttggttcctctcagcatccatcagtgcaatgcatgcaggctctcagagttgcaactgtggagcagggaaacatcgatccatatagcgtttatacgcggccttgtaacaatacagcatcactcagacgcggcttgaaggggcgctatccatggatgtctcgagcatatgatccatgtactgaaaggtattctgatttgtatttcaaccgtccagaagttcagaaggcatttcatgccaatgtaactgggattccttatgcatggaaagcttgcagtgatattgttgggaactattggactgattctccattatctatgcttcctatatatcgagaacttattagtgctggtctccgaatatgggtctacagtggagacactgatgcagtggttccaatgactgctactcgatattcaattgatgccttgaagctacctaccatcatcaattggtacccttggtatgataatggcaaggttggtgggtggagtcaagtttataaagggttgacattggttacagtaagaggagctggacatgaggttcctcttcataggccccgtcaagcattcattctttttaggtcattcttggaaaacaagtccatgccatccacaagttag

SEQ ID NO: 4232 - DNA, 1254 bp, Glycine Max
atgatgggttatccttcaagactctatcttgttttgcttttgtccatttgtggggtggtttctttagcttccccaattgaagatcagaagagagatagaattactcagcttccagggcagccaaagaatgtgggatttgctcagtattcaggttatgtgactgtgaatgagcaaagtggaagatcacttttttactggttggtggaggcaccagtgaagcgtggaccaaagtcaaggccactagtgttgtggctcaatggtggtccaggatgttcctctattgcttatggtgcatctgaggaaattggtccttttcacattaggcctgatggcaagtcactttacttgaacccttatgcttggaacaatttggcaaatgtactgttccttgattctcctgctggtgttggcttttcatattccaataagtcaacagatctgtatacatttggtgaccagaaaacagctgaagatgcatatacttttcttgttaattggtttgaaagatttcctcaatataagcatagagaattctacattgctggagaaagttatgcaggtcactatgttccccagttgggtcaaattgtttacgagaaaaataagggaatcaagaatccagttataaattttaagggatttatggttggtaatgctgttactgatgattatcatgattatattggcacatttgaatattggtggacccatggtttggtttcagattccacgtataggatgctaagaattgcctgcaattttggttcctctcagcatccatcagtgcaatgcatgcaggctctcagagttgcaactgtggagcagggaaacatcgatccatatagcgtttatacgcggccttgtaacaatacagcatcactcagacgcggcttgaaggggcgctatccatggatgtctcgagcatatgatccatgtactgaaaggtattctgatttgtatttcaaccgtccagaagttcagaaggcatttcatgccaatgtaactgggattccttatgcatggaaagcttgcagtgatattgttgggaactattggactgattctccattatctatgcttcctatatatcgagaacttattagtgctggtctccgaatatgggtctacagtggagacactgatgcagtggttccaatgactgctactcgatattcaattgatgccttgaagctacctaccatcatcaattggtacccttggttggtgggtggagtcaagtttataaagggttga

SEQ ID NO: 4233 - DNA, 744 bp, Glycine Max
atgatgtcacgttttatgaatgctccttcctctccaggattgtctcctctgtttggcgttggccacaagagagcccgtgaagacgacacggcttcttcacaaacacaagggaatgaaagtggcggcggcgagaggaggaggagatacagaggagtgaggcagaggccgtgggggaaatgggcggcggagattcgcgatcctcacaaagcggcgagagtgtggcttgggacattcgacactgccgaggctgcagccagagcttacgatgaagccgcattgaggttcagaggtaacagagccaaacttaatttccccgaaaatgttgtacaggttcaacctcctcctccgcttccaaatttaccggcaagttttgcgccgacggtgatgcaggggacgcggtttcaggactcctctgattttctgagagactattgggggtattctcagctgctgaggagtacaggggagttccatggactcgaccactggttctttgattcgcaaatggcagcgtttcaatcttctttgccgtcttcgttgttgccatcaccgccgccgccggcgtttctgccttcctctgcttcgtatcctctgttttcttctagccagcaaatggggattttccggccgccgggagagcagggtcacggcggagaagacggtggtagcgggtcggggttcacagagcttctaccttcgacttggtcagataccagtggctatcctcctccaccacctggttga

SEQ ID NO: 4234 - DNA, 1035 bp, Glycine Max
atgattgaaagggagataaactctgtcaatgataaccccttgattgatgtttcaaggaataaggcactccatggggggaatttccaaggtaccccaattggtgtttcaatggataacacccgtttggctattgcatcaattggtaaacttatgtttgcccagttctctgaacttgtgaatgacttctacaacaatggtttgccttcaaatctaacagctagtcgcaatccaagcttagactatggattcaaaggtgctgaaattgcaatggcatcctattgttcagaactccaataccttgccaatcctgttaccactcatgtccagagtgctgagcaacataaccaagatgtgaactctttaggcttaatttcctctagaaagacagctgaagcaatagatgtattaaagctcatgtcatccactttcttagttgctttgtgccaagccattgatttgaggcatttggaggaaaacttgaagaacactgttaagaataccgttagtcaagtggccaaaagagttctcacagttggcatcaatggcgagttacatccttctaggttttgtgagaaggacttactcaaaattgttgatcgtgagtatgtctatgcttacattgatgacccctgtagtgcaacctaccctctgatgcaaaagttgagattagtcctagttgatcatgcattgcaaaatggtgacaaagaggcgagttcaagtacctcaattttccaaaagattggtgcctttgaagaagagctcaatgcccttttgcccaaagaggtggaaagtgctaggattgaagttgagaatggaaatcctgctattcctaaccgaattaaggaatgcaggtcttacccattatataagtttgtgagagaaaatttgggtacaactttgctaacaggagagaaagtcaagtcacctggtgaggaatctgataaggtatttactgcattgtgtgaagggaagttcatcgatcctttgttggactgtctaaaagagtggaatggtgctcctctaccaatatgctga

SEQ ID NO: 4235 - DNA, 306 bp, Glycine Max
atgattgtagcagctagctggaggattatcattatagccactggactggggaatctcatacaacaaaaaggaatggaccactctctctctctctctcccctttcaattggcttgcagggaatatggtatacggtcaaagcaggtcaaaagcttacaaaaggacattattggtcaggctattgtgggaccacccacaccctaacaccctcctggggaaatcaattctgggattttgtgtttttttttctcttcttctcaaacatttcactgtacttagtttgcaatctttttttattcctactataa

SEQ ID NO: 4236 - DNA, 972 bp, Glycine Max
atgcaaactctttcacggttgcagtctcaggttcgtgcaaggaaggtcagaatgtctgaggagaatcaatctcttcaaaggcaactgcagcagaaacgtgaaaaggaatttgacaagtcgcaagctaatcagattggagagaagtgggatgatagcttgaaatcaaaggagcaagttgaagccaaattgttgaacaggcaagtagctgctatgagaagagaaaaggctttggcctatgcatcaacacatcaacaaacgtggaggaactcttcaaaatctgctacaaatgccacatttatggatccaaacaatccccattggggttggaattggctagagcgatggatggctgcaaggccgtgggagggtcaaaacactacataccacattggccatgcatctgccaaaagtgttgcaagccaaaccatgtcagttggtgaaattactaaattgtattctctccgtgatcagaataatgatatcaaaacttcaccagcaaaccaaaaaccaacccgtccctgcagccacaattccccttcaacaacaccctcaaaggtcccattagccaatggagcaaaaacaaaggtactatcaagttcaaggggtggttcatgggggggtgatggtgactcaaaaagcatgttcagcaaaaacttagaaaacactcgcaggcacagcattggagtgtctcaagtgagagatgatgagagcaattcaagctcatcaccgtctacaaaggtcgcaaccaaggtaaagtcatcatcatcatcatccaaagtgagaagtgcatcgtttggtgtacatagaaatggaacacctgaaaaagcaacttctgctcccctaaagaagaggctttcttcccctgcttctccagccggtataagaaggtatgctgtttcaactaggccgggaaatgtggcttccaacaagagtgttgctaatgctataccatctctgatgaggagaaagtga

SEQ ID NO: 4237 - DNA, 897 bp, Glycine Max
atgcaaattcagtggtgttctggaatgagattcaaaatgccctttgagactgaggattcttctaggatcagctggttcatgggaaccatttcttctgttcaggttgcagatcccatccgttggcctgattctccttggcgtcttctgcaggtggtgtgggatgagccagatttacttcaaaatgtcaagtgtgtgaacccttggctggttgaactagtctcaaacatgcctacattcaatctctctgcatactcacctcctagaaagaaacaacgttttcttcaggatccttattttcaagtcatcaaccaactcccaatgccatcattctctagcaaccttctcaattacaccaactctctttgcaccattcaagatagtaatagttctggaggcatacagggagccaggcatgctcaatttggactatctccatctgattttcccttcaacaagctcccagcagacatgcttctaggtggtttctcaaggcttgaccatgcagcagcacagcctattaggccaccttgtggaacctataagaacaacaccactactaaggccaatgttggcatttcttgcttgttgacagtgggaaatcctggccagaatttcaaggaatccaatgaaacaaaagcacctcacatcttgttatttggaaaactcattcagactgagcaaaagagttcaaacactagctctgccaatactaatggtaatagtgtatctgaggggaattcacacaagacatctaatgcttccgatggcgtaggttctggtttgcatcaaggtagtccaattgagaacaattctgatggagggtctccctggtacaaggaccaacacaagtctgatcttggaactgacaatgttaacacattgtgtattgctttataa

SEQ ID NO: 4238 - DNA, 624 bp, Glycine Max
atgcaatcctggatctgtaacgctctttctttctctcgtttttctccttttttgcttcccgattttactgttttgccactgattggtgcggttgatgcttgttttctcgctgatcgcagcaaatcgaagctttaccggttcgacaaggacgggaaccagtggaaggagcgtggcgccggcactgtgaagttcctgaagcataaggcttccggcaaggttaggcttctcatgaggcaatccaagacgctcaagatctgcgctaatcatctcattttgcctacgatgagtgtgcaagagcacgctgggaacgagaaatcctgcgtttggcatgctagggattttgctgatggtgaactcaaggacgagctcttctgcatccgttttccttctattgaaaattgcaaaagcttcatggaaacattccaagaagttgctgaaacacaaaaggcagaggatgagaaggaatcatctgatgcagctggtcttattgagaaattaagtgttgaagagaaggctgatgcagagaagaaagatgaagagaagtctgaggacaaaactgtggagaaagaatctgcatcaggaaaggaaagcaaggcagttgaagagcctgcgtcctcagcttga

SEQ ID NO: 4239 - DNA, 606 bp, Glycine Max
atgcactatgcattgcactcccgcgtcaaacctcacaagaatcacacaatcctacttattctctactccaactacagcatttcccaaaaaaaaaaaaaaaaacactatcgtaataatatcatcatatctcacacgacaaacacaaaaatgctatcatacaattacactttcaaacacttggctctctttcttttcttcttgatcacttccaccacagcggcagccggaggcgccagaaggcagcttcgttttgacatgtcaaacggcggtgcaccatcgaccggaacccccacgggggccactggcaccggccatggtgcaaactggaactacagctggggatggggctccggacccggcactgggtatgggtatgggtatggttcgggtaggtctccgacgggttttgctagaggctatggctatggttttggatctggatccgggtcaggatccgggtacggctatggatccggtggtggtggtactcgggctggtggttatgggtctggaagtggttcgggaaactctggtgacagaaatggtggtgatgacaataataataagttaccatcatcatctaggggaaaatccaaccatgggtaa

SEQ ID NO: 4240 - DNA, 678 bp, Glycine Max
atgcacttccccattctctttctcttccttctaccttcactcttcaagttttcatattcagccacaattctagtagacggatcttcagagtggaagaaccccactgtttccatcggtgactccatcattttcaagcacaagcaacactacaacctctacattttcaagaacgagaaagccttcaagctctgcaacatcactcaagccactcttctcaccaacccctacacgtggcatccatctcggcctggtttcttctacttcaccttccataatgggtcactgaaagcgtgccaagattctcaaaagctagccatagaggtaacttcttcagcaatggctccagaagtttctccggctccttcttctggtggagaggtaccatcttctccttcgtttccatggccttttcatccaggacaagaagcttcttcacctggtcctgcaccacaagcacaagcacaagcaagttcgccggtgacaattccgttagtgccggataaaggtggtggcatgcccttcattaacagcaaccctgcagttcctctacctactggtgaagttgactctgctaccatacgccccttacccatcacctctggccatcaaggacaggtgatgattgggtcatttggacttcatattgcattgcacaccatggctttactgctattataa

SEQ ID NO: 4241 - DNA, 1041 bp, Glycine Max
atgcagaagcatggttttgcatcaaagcgtaacgtgttgccgtatcaaacgccgaggctaagggaccactacgttctggggaagaagctgggacaggggcaattcggtacgacgtacctgtgcacccacaaggttacagggaagctctacgcgtgcaaatcgatcccgaagaggaagcttctatgccaggaggattacgatgacgtgtggagggagattcagatcatgcaccatttgtcggagcatcccaacgttgtccagatacaaggcacgtacgaggattccgtgttcgtgcaccttgtcatggagctctgtgcagggggagagcttttcgacaggatcattcagaagggtcattacagcgagaaagaggccgccaagttgataaagaccattgttggggtggtggaggcttgccactctcttggggtcatgcatagggatctcaagcctgagaatttcttgtttgatacccctggtgaagatgcacagatgaaggccaccgattttggcctctctgtcttccacaagccaggacaagcctttcatgatgtagtgggaagtccctactatgttgcccctgaggtgttgtgcaagcaatatggaccagaagtggatgtatggagtgctggtgttatcctatacatcttactgagcggggttccacctttctgggctgaaaccgaagcaggaattttcagacagattttaaatggagatcttgatttcgtttctgaaccgtggccaagtatctcagaaaatgctaaagaattggtaaaaaagatgttggatagggaccctaagaaaagaatttctgctcatgaagttttatgtaacccttggattgttgatgatattgcgcccgacaaacctctggactctgctgttttgacacgcctaaagcttttctcagcaatgaataagcttaagaagatggcattacgggtatgtcaatttctacgaatccatttctctcatattagaggtcatagcagaaagactttcagaggaagaaataggtggattgaaagagttgtttaa

SEQ ID NO: 4242 - DNA, 1479 bp, Glycine Max
atgcagaagcatggttttgcatcaaagcgtaacgtgttgccgtatcaaacgccgaggctaagggaccactacgttctggggaagaagctgggacaggggcaattcggtacgacgtacctgtgcacccacaaggttacagggaagctctacgcgtgcaaatcgatcccgaagaggaagcttctatgccaggaggattacgatgacgtgtggagggagattcagatcatgcaccatttgtcggagcatcccaacgttgtccagatacaaggcacgtacgaggattccgtgttcgtgcaccttgtcatggagctctgtgcagggggagagcttttcgacaggatcattcagaagggtcattacagcgagaaagaggccgccaagttgataaagaccattgttggggtggtggaggcttgccactctcttggggtcatgcatagggatctcaagcctgagaatttcttgtttgatacccctggtgaagatgcacagatgaaggccaccgattttggcctctctgtcttccacaagccaggacaagcctttcatgatgtagtgggaagtccctactatgttgcccctgaggtgttgtgcaagcaatatggaccagaagtggatgtatggagtgctggtgttatcctatacatcttactgagcggggttccacctttctgggctgaaaccgaagcaggaattttcagacagattttaaatggagatcttgatttcgtttctgaaccgtggccaagtatctcagaaaatgctaaagaattggtaaaaaagatgttggatagggaccctaagaaaagaatttctgctcatgaagttttatgtaacccttggattgttgatgatattgcgcccgacaaacctctggactctgctgttttgacacgcctaaagcttttctcagcaatgaataagcttaagaagatggcattacgggtcatagcagaaagactttcagaggaagaaataggtggattgaaagagttgtttaaaatgattgacacagataatagtgggacaataacttttgaggaactcaaggcgggtttgaaaagtgtgggctctaatctcatggaatctgaaattaaatcccttatggaagcggctgatatagacaacaatggatcaatagactatggtgaatttcttgctgctacactgcacttgaataagatggaaagagaggagaatttggttgctgcttttgcctattttgataaagatggtagtggctacatcaccattgacgagcttcaacaggcttgtaaggacttcagcctaggtcatgtacatctggatgagatgatcaaagagattgatcaagataatgatgggaggattgattattcggagtttgcagcaatgatgaaaaaaggtgatccaaatatgggtagaagcagaaccatgaaaggcaatttgaacttcaatattgcagatgcatttggaatgaaagacaaagactcttcttga

SEQ ID NO: 4243 - DNA, 2901 bp, Glycine Max
atgcagatgggcggtgggagtaaggtagatttgcaaacattagatgagggtatgcagcctttggcaaatgggactattgaagacaccttgcagagtgagctggagaagatactgcaagagcagcgtaatcggcaatttatcaatcgagagagggaatacaatattagtaggagtggaagtgcaccgccgacagtggagggatcgttgagtgcttttgggagcctaaggaactctgatttcggattgatcaatgataggaggagtaataacaatggacttttgactgaagatgagatacgatcgcatcctgcatatctttcttattattactcacatgagagtataaatcctaggttgcctccacctttgttgtcgaaagaagactggcgtgttgcacaaaggtttcatggtggtgggtcttcttcaattgagggatttggggactggaggaagaatgtagctcccaatggcgatagttcgtctctattttcaatgcagccaggattttctgtgcaacaggtagagaatgatttgatggaactgagcaaagccagtggatggaatgtctctaggcagggttcaagtcagatgctcgacagacatatgggtggtttgacaagaatgtcaggagctggtcttggtgggaggagaacgagttatactgacattcttcaggaaggacttgagcaacctacaatgttgtctagcaccatgtcacgtccagcgagtcacaatgcatttggtgatattatggcttctacccctggtttggttggacttcagaaccatggtgtaaatctttctcatagttttgcaccctctgtgggcacttctctgtcaagggtgaaaacccctgaaccacaggttattgggagacctgttgggtctgcagcttcccaaatgggtggtaaagttttctctgttgagaatagtggtatgggcgtgggcagccagcatggccattcttccaatatgactgatcttactgatgtggtgtcttctttagctgggttaaatttgtcaggtgttagacatgcagagcaagatagtcttttgaaatctaagctacaaatggatgttgataaccatgctgatgttctactaaacacgcaaagcaatgttaatttgcccagacataatgatattgtgacaaaccttaacacctttagttcaaatgaccatgtcaatctactgaaaaaaactgcttcttctgctaatcttcgctcaaaagtgcattctactggaaatgcagcaagtttgccaagtgcagacttcactggccatgttcctagtgcatatcttgtaaactcgaaattgaattctgtttcgataaataatctcgagacagctatgagacttcgcagagatggacaaagtttagatgcacaaggaaaccatgttggtcctgaacttcattccacaactctggacccacgcttcatccaatgcttgcagcaaagtgctgattactcgatgcaagggatgagtagttctggtcatcctcttcaaatgagaaatttccccgatgcttcacatggagatttggagggacttaggaaagcatatcttgagacacttcttactcaacaaaagcaacagtatgaactaccacttctgagcaaatctgggctgactaatgggttctatgggagtcagccatatggtcttggcatgccatattctggaaagcagattgcaaattccacacttccttctcttggatctggaaatccactctttgagaatgaacgtatttcacgcttaaattccatgatgagaagttcaatgggaggttctggtggctcatggcatgctgatatttgcaataatatagagggaagatttgctccatccttactagacgagttcaagaacaagaagaccaggccttttgaacttccagatatcattgatcatgtggttcaattcagtactgatcagtatggtagccgctttattcagcagaaattagaaacggcatctgtagaagagaagaccaagatatttcctgagatcattcctcatgctcgtgccttaatgactgatgtttttggcaattatgttatacaaaaattttttgagcatggtaccgaaagtcaaagaaaggaattagccaaccaacttacaggtcatgttttacctcttagtctgcaaatgtatggttgcagagtgattcaaaaggccttggaggtggttgatgtggatcagcagggtcaaatggtgtctgagctcaatggtgcaataatgaaatgtgtacgtgatcaaaatggaaaccatgttattcagaagtgtatagagtgtgtccctcaagataaaattcagtttattgtttcatccttttatgggcaagttgttgcactttctactcatccttatgggtgcagagttatccagagggttctagaacattgtgatgatcaaaatacacaacaaattatcatggaggaaatcatgcaatctgtcagcactttagcacaggatcaatatggaaattatgttattcagcatattgtggaacatggtaaaccacatgaacggactaccattatcagcaagcttgctggtcagattgttaagatgagccagcaaaagtttgcttcaaatgttattgagaaatgtttggcttttggtagtcctgaagaacgtcagattttggtgaatgaaatgcttggcacttctgatgagaatgagcccttacaggctatgatgaaggacccttttggaaattatgtagtgcaaaaggttcttgagacttgtgacgatcgaagtcttgagctgatcctttctcgcatcaaggttcacttaaatgcactgaagcggtatacttatggcaaacatatagtttcccgtgtggagaagctgataaccactggagaaaggcgcatagggttgttggcctaa

SEQ ID NO: 4244 - DNA, 2916 bp, Glycine Max
atgcaggttccggctcgcatcgagaaactcattgctgagaagcaattttatgccgcggttcaattgcatgtgcaatcaatactgatgcttgagcgaggcctccaaactgttggggcgcttcaagatgtccgttctgagttaacgaagttacgtggagtcctcttttataagattttggaggatttgcatgcccatttatacaataagggtgaatatagtgctgctggctcaagtttgttagagaatgatgacgaaataccaaccaccactgctgttgcacttgctgcacataattcacaacctctgtctcgaagaacaagatcactcaaaggtgacaatcagaataatctccagattgatggatcgtataggccagcatctgtggatggaggttcttttgatggccatgatgaggcagatttgaatgaggaagctaccttagatgggaatatggcaacaacgagaatcaatggtaatgatataccaaaggattccaacaatgctcttcgtcaaatgccaacatggctctcaaattcgacacctgatgaatttcttgaaacaattagaaaaagtgatgctccgcttcatgtgaagtatctccagaccatggtcgagtgcctttgcatgcttggcaaagttgcagctgctggagctattatatgccaaagattgcggccaacacttcacgagataattacatccaagattaaagctcatgcagagcttttgaattcatcaaggtctagcattggtcaggattcccaggctggaacaggtaatctgcacttcataaaaggtcaactagaaagttatcagttgccaaaacagaagcgtaagaatggaatatctattgctggaactctgttggctgtgagccctgtatcacctcttatggctcctggtgggaaagcacaggttgctgctaaggagcttcttgattcaattttggatgctgttgttcgaatatttgagaatcatgtcattgttggggagcttttggaagcaaaagcaagtcagcatgctgacataaacacgccaaaatcattgccagtagatgtaaattggaaccctgattctgaagcatctcaagtcaccggaggttacagcataggtttctccctgacagtgttacagagtgaatgccaacaacttatatgtgaaattctgcgggccactcctgaagcagcatctgctgatgctgctgtgcaaacagctaggcttgcgagcaaagtcccttctaaagataaaagggatggatctgaagatggtcttacctttgcatttcgctttacagatgcttcaatatctattcctaaccagggagttgatcttgttcgccaaggttggagtaggaagggtcccaatgtgcttcaagagggttatggttctgcagcagttttgcctgaggagggcatatatttagcagcatccatataccgacctgtgcttcagttcacggataaagttgcttcaatgctgccaacaaagtattcccaactcggcaatgatgggttgctagcttttgtggagaactttgtgaaggaccactttttaccaactatgtttgtagactaccgaaaaggcgtacagcaagccatatcgagcaacactatgcttggctcctattttggtctattgtgcatcttaattattttttttggaaacatccaagttgtagtatgtcaattatgtgttgaaagagtattgaagttagctttgtctgaaatgtttgatgtaaatggtccagctgcatttcgtccaagggcacatgttgctactacttacacttcatcaattgagaagggtcgacctgttttacaaggattattagctatagatcacttaacaaaggaggtgcttggctgggcacaagcaatgcccaagttctctaatgatctggtgaagtatgtgcaaacttttctggagaggacttatgaaagatgccgaactgcatacatggaggctgttcttgagaagcagagttatatgcttattgggaggcatgatattgagaagttgatgaggattgacccctcaagtgcatatttaccgaatctgcttggtcagttaaatgtggaaagtaattcatctgatgctgaaacaattgaggctgaattagaacttagtgaattactgctaagtttgcgtcctattaagcaggaaaacctaatccatgatgacaacaaacttattctgttggcatcccttagtgactcattagagtatgttgcagactctattgaaaggcttggacagacaactcaaagagcatcaaatcatgttgggggaaaataccatcacagtcattcagacagtgcacctacaaggagtttagtttcatttgctcaagattataggaaactggcaattgattgccttaaggttttacgcatagagatgcaattggagacagtattccatatgcaggaaatggcaaatacagaatacttggatgaccaagatgctgaagagccggatgacttcatcatttcgctcactgcacagataacacgaagagatgaggaaatggctccttttatttcaaatgcaaagcggaattatatatttggtggaatttgtggggttgcagcaaatgcatctgtcaaggctttggcggatatgaaatccataaatctttttggtgttcagcaaatttgtcgaaatgctattgcattagaacaggcattggcagctattccatccataaatagtgaagcagtgcaacagagattggatcgagtccgcacctactatgaactattgaacatgccatttgaggctttggttgccttcattacagaacatatacacttgttcacccctgtggagtatgccaagcttcttaatgttcaggttcctggaagggaaattcctcctgatgcacaagatagattatctgaaatattatccgtgtag

SEQ ID NO: 4245 - DNA, 1056 bp, Glycine Max
atgcatcacttgccacgcttggagccccgatcaatccagttggttgaagacaaatgggaaaagttgtatgttcttcaaaagcatgaccaggtaatttctgggatagactggagtgcaagatcaaatagaatagttactgcatcccatgatcggaattcatatgtctggaacctggaaggatcagaatgggtgccaactcttgtgattcttagactaaaccgtgctgctctttgtgttcaatggagtccaaaagaaaacaaatttgcagtgggaagtggagccaaaactgtttgtatatgctactatgagcaggagaacaactggtgggtcagcaaacttatcaggaaaagacatgattcttctgtgacaagtgtttgttggcatcccgataatattcttcttgctacaacatccacagatgggaaatgcagagtattctccacctttataaaaggcgttgatgcaagggattcgaaaaagggtacttcaccagattcaaaatttggagagcaaattgttcagcttgatctctcatcgtcttggacattcggagtcaagtggtcaccaagtggcaatactctagcgtatgtaggtcataattctatgatatattttgttgatgatgttggtccttctcctttggcccaaaatgttgtgttccgtgatttgccgctccgtgatgtattatttgtttctgagagaaaagtgataggtgtgggatttgattgtaacccaatggtttttgctgcagatgaaaggggaatttggagttttgtcagatatttggcagaacggaaagcagtatcttctggatcaagatatggctcacagttctctgaagcatttggaaagttttatggccaatcgaagcatggagtgagcaatgatacagttgaaacttcaagaactcgtggaactgttcacgaaaactgtataaattgtattatgcctcttggggatcatggcacattgctaaggcgtttcagcacatcaggattggatggaagaattgttgtatgggatttggaaaatgagcaagacctgttggaattataa

SEQ ID NO: 4246 - DNA, 795 bp, Glycine Max
atgcatgagttctccattgttgatggttttgtggagataagtgaatgcatggcagagatgaccaagtacgtggctaatgaaccatccgttgggcttttctttatccaacagcatgctcaaaatgcagtacccaatatcatcaaagttaagaaaaatgttgttgagaagtctcatgaaacaactttgcacacagaagatttggaggactctgtcacaatggttcaatcaatgaaagagtgtggatttcccatagctgataagatgatcagagagattaaaaaatctctgataactatggaaacaaaacaaccgaaaagagggttaatccatccagcatcaagttctcattcagaaagagctagtttcttgggtaacgctgcattttatgctcaggagggcaatgaaaaaaggagtaactatttctcaaatgttttgaagtcagcaaaagagaaggctggcagcttcaagtggcggcagcttgatactcggggatcaatagattccacggatgagaagccaccaatgtaccctaatttgccgttgttggtcacatctgcaagcattacttcatcttttcgggctgccgaaactgatgagttgcctgtatcaagccaggttgaagacgagtctcagcacaaacagaccgatgttagtgatatcagcattaatttattgtcagtatcagaaagattcgacgacttcaaagctaataaagaagctaaactagcggagtggctggacggaactggcaaccttgatgataattgcggcacaggtgatgagaaaaggtcttag

SEQ ID NO: 4247 - DNA, 795 bp, Glycine Max; identical to SEQ ID NO: 4246

SEQ ID NO: 4248 - DNA, 795 bp, Glycine Max; identical to SEQ ID NO: 4246

SEQ ID NO: 4249 - DNA, 558 bp, Glycine Max
atgcattcccatatcgagagaatcctatggagcgaggaccaaatttctcgccgtgtctccgagctcgccgccgaaatctccgccgacttcggcggacaatctccggctcccgtggtcgtcggcgtggccaccggtgcattcctcttcttggctgacctcgttcgcaaaatagatctgtccatcgccgttgatttcgtccgagttgaatcctacggtttcggaaccgtttccaatggcgcacccaccatttccttcgatttgaaggtcgacgtcaacgcccgtcacgtcatcgtggttgaagacattgtagatactggacataccttatctaaagtcattgggcacttgaaatcaaagggagtatcctctgtttctgtatgcactttccttgataaacctgcaaggagaaaagttcattttcagttgctgggtgaagggaaatactaccggggatttgagtgtccagactatttcgttgtaggttatggactggatttcgctgaactctatagaaatttgccttacattggtgttttgaagcctgaactttacaagtga

SEQ ID NO: 4250 - DNA, 2970 bp, Glycine Max
atgcatttgagggtgcacattattgtggtattgagcttgttccttgggatgatacagttacagtgccaacaagtgaatgactatgatcagattgatagccctgctgttcttcctctccttactcagcttgtctatagtcaaatctccaacttgacatcaattctcagtcaggaaattagcaaagagtctactttctgtgtcaaagatccggatgctgattggaatcaagcatttaatttttcatctgatttgggcttcttggcgtcttgcattaagaagactagaggagatattgcaaaacgtttgtgtacagcagcagaagtgaagtttttcttaaatagtttgttggagaaatctgtaagtgccaattatttaaagcctaacaagaactgcaatttaacctcatgggtccccggttgtgagccgggatgggcctgtagtgttccctcaagccagaaggttgacctcaaaaattcaaaggagatacccgcaagaactttgaattgtcaagcctgttgtgaaggcttcttttgtcctcatgggattacatgcatgataccatgccctctaggttcctattgccctcttgctacactcaataaaacaactggcgtatgcgaaccatatctttatcagctgcctccaatgcagacaaaccatacctgtggtggagcaaatgtttgggccgacgttagtagcagtagtgagatattttgctcagctggatcatattgtccaacaaccacaaaaagaattccctgcagtagtgggcattactgcaggatgggctccacatctgagaaaagatgcttcaagttgagttcatgtaattcaaacaccgcaacccaaaatatgcatgcatatggaattatgctcattgctgctttgagtactttgctactcattatttacaattgttctgaccaagttctaactactagggaaagaagagtggccaaatctagagaagcagcagctagaagtgcaaggaagactgcaaatgcacgccaaagatggcgatttgcaaaagatgccactaagaagggtgcaatggggttgcaagctcaactatcacgcaccttcaagaaggatgctgcaaatctggaaaaagttaaaattttgaatcaagcaacttctgaagtgggtgttgaattgttatcacattcacgacctacaacttcaagcatggttgcaacttcatctatggcaacaaaggaaaagggaaaagaacccagcaatataaatgacaaccttcatacagaaatagaaactagagatacaggtgttagagaaaattatgcatattctcaacttgaaaaagagaaggctcaacaaaaagaaaacaagaagcttaccttctcgggggtaattaaaatggctacaaacactgataaaaggaaaaggcctttaatggagatttctttcaaggacctgactcttacattgaaagctcaaaacaaacatatattgagatatgttactgggaaaattaaacctggccgcatcactgctgtcatgggtccatcaggggctggcaagacaacatttctttcagctctagccggaaaagcattgggatgcttggtcactggttcaattcttataaatggaaggaatgaatcaatccactcctttaagaaaattactggctttgtgccacaagatgatgtagttcatggaaatctgacagtggaagagaatctctggttcagtgcacagtgcaggctatctgctgacttgtcaaaaccagaaaaagttctagttgttgaaagagttattgaattcttagggcttcaatctgtgcgcaatgccttggttggaactgtggaaaaaagagggatctctggaggccaaaggaaacgtgtaaatgttgggttggaaatggttatggaaccttcactcttgatcttggatgaacccacatctggcttggacagtgcatcatctcagctccttcttagagcactaagacgcgaagctcttgagggagttaacatttgcatggtggttcaccaacccagctatgctttgttcaagatgtttgatgacctgatacttctgggaaaaggtggtcttactgtctatcatggatctgccaagaaagttgaagaatacttttcaggcgtggggatcaatgttccggagcggattaatcctcctgattacttcattgacattttggagggcataacaacccctggagggggctcaggactcagttataaagagcttccggtaagatggatgcttcataatggatatccaatacctcttgatatgaggcagaatgcagttcaatttgatatgtcccagagtgtaaattcagcaaatgaaatagattccaatggatctggtcatgtcggaaaaacctttgctggagaattatggcaagatatgagaaacaatgtggaactgaagagggagaagataagactcaatttttttaaatccaaggatttatctaaccgggaaactcctggtgttttcaagcaatacaagtactttcttatacgggttgggaagcagcgactacgagaagctaggatccaagccattgattatcttattttgttacttgctggagcctgcttaggatcactttccaaatcaagtgaccaaacatttggtgcagctgggtacacccatacggtgattggtgtatctcttctgtgcaaaatagcggccttgagatcattttctctggataaattacactattggagggagagtgattctggcatgagcagcttggcttatttcctctctaaagacacaattgatcattttaatacactgatcaagcctgtggtgtatctttctatgttctatttcttcaccaatccgagatcaacttttgcagataattatgttgtgctgctttgtcttgtatactgtgtcactggcatagcatatgcattgtccatattttttgaacctggtgcagcccagctggtaagtattagaagctga

SEQ ID NO: 4251 - DNA, 3243 bp, Glycine Max
atgcatttgagggtgcacattattgtggtattgagcttgttccttgggatgatacagttacagtgccaacaagtgaatgactatgatcagattgatagccctgctgttcttcctctccttactcagcttgtctatagtcaaatctccaacttgacatcaattctcagtcaggaaattagcaaagagtctactttctgtgtcaaagatccggatgctgattggaatcaagcatttaatttttcatctgatttgggcttcttggcgtcttgcattaagaagactagaggagatattgcaaaacgtttgtgtacagcagcagaagtgaagtttttcttaaatagtttgttggagaaatctgtaagtgccaattatttaaagcctaacaagaactgcaatttaacctcatgggtccccggttgtgagccgggatgggcctgtagtgttccctcaagccagaaggttgacctcaaaaattcaaaggagatacccgcaagaactttgaattgtcaagcctgttgtgaaggcttcttttgtcctcatgggattacatgcatgataccatgccctctaggttcctattgccctcttgctacactcaataaaacaactggcgtatgcgaaccatatctttatcagctgcctccaatgcagacaaaccatacctgtggtggagcaaatgtttgggccgacgttagtagcagtagtgagatattttgctcagctggatcatattgtccaacaaccacaaaaagaattccctgcagtagtgggcattactgcaggatgggctccacatctgagaaaagatgcttcaagttgagttcatgtaattcaaacaccgcaacccaaaatatgcatgcatatggaattatgctcattgctgctttgagtactttgctactcattatttacaattgttctgaccaagttctaactactagggaaagaagagtggccaaatctagagaagcagcagctagaagtgcaaggaagactgcaaatgcacgccaaagatggcgatttgcaaaagatgccactaagaagggtgcaatggggttgcaagctcaactatcacgcaccttcaagaaggatgctgcaaatctggaaaaagttaaaattttgaatcaagcaacttctgaagtgggtgttgaattgttatcacattcacgacctacaacttcaagcatggttgcaacttcatctatggcaacaaaggaaaagggaaaagaacccagcaatataaatgacaaccttcatacagaaatagaaactagagatacaggtgttagagaaaattatgcatattctcaacttgaaaaagagaaggctcaacaaaaagaaaacaagaagcttaccttctcgggggtaattaaaatggctacaaacactgataaaaggaaaaggcctttaatggagatttctttcaaggacctgactcttacattgaaagctcaaaacaaacatatattgagatatgttactgggaaaattaaacctggccgcatcactgctgtcatgggtccatcaggggctggcaagacaacatttctttcagctctagccggaaaagcattgggatgcttggtcactggttcaattcttataaatggaaggaatgaatcaatccactcctttaagaaaattactggctttgtgccacaagatgatgtagttcatggaaatctgacagtggaagagaatctctggttcagtgcacagtgcaggctatctgctgacttgtcaaaaccagaaaaagttctagttgttgaaagagttattgaattcttagggcttcaatctgtgcgcaatgccttggttggaactgtggaaaaaagagggatctctggaggccaaaggaaacgtgtaaatgttgggttggaaatggttatggaaccttcactcttgatcttggatgaacccacatctggcttggacagtgcatcatctcagctccttcttagagcactaagacgcgaagctcttgagggagttaacatttgcatggtggttcaccaacccagctatgctttgttcaagatgtttgatgacctgatacttctgggaaaaggtggtcttactgtctatcatggatctgccaagaaagttgaagaatacttttcaggcgtggggatcaatgttccggagcggattaatcctcctgattacttcattgacattttggagggcataacaacccctggagggggctcaggactcagttataaagagcttccggtaagatggatgcttcataatggatatccaatacctcttgatatgaggcagaatgcagttcaatttgatatgtcccagagtgtaaattcagcaaatgaaatagattccaatggatctggtcatgtcggaaaaacctttgctggagaattatggcaagatatgagaaacaatgtggaactgaagagggagaagataagactcaatttttttaaatccaaggatttatctaaccgggaaactcctggtgttttcaagcaatacaagtactttcttatacgggttgggaagcagcgactacgagaagctaggatccaagccattgattatcttattttgttacttgctggagcctgcttaggatcactttccaaatcaagtgaccaaacatttggtgcagctgggtacacccatacggtgattggtgtatctcttctgtgcaaaatagcggccttgagatcattttctctggataaattacactattggagggagagtgattctggcatgagcagcttggcttatttcctctctaaagacacaattgatcattttaatacactgatcaagcctgtggtgtatctttctatgttctatttcttcaccaatccgagatcaacttttgcagataattatgttgtgctgctttgtcttgtatactgtgtcactggcatagcatatgcattgtccatattttttgaacctggtgcagcccagctgtggtcagtacttctgccagttgttttgactctcattgcaacacaaccaaaagatagtaaagttttgaagaatatagctaatttatgctactctaagtgggctttacaagccttagttgttgcaaatgctgaaaggtatcagggagtgtggctcataactcgttgtggttcacttttgaaaactggctataatcttcacgattggagtttgtgcatatctatcctcattctaatgggtgtaatttgccgggctatagcatttttctgtatggtcaccttccgaaagaagtaa

SEQ ID NO: 4252 - DNA, 1344 bp, Glycine Max
atgccaaatggcagtctgcactcagagccagcaagcggtgtcaattttaacaatcaagaaagcgtcataagcttgaataataagaggattgattttttcaaaacatggtccagtaaactagggggacacatatcagttatgagtggaaaggtacatacagaaagtgcagaagatgataacagcttatgcaacactaataagcctttacctgttgatttgttcttcaaaacattggagggtccacagttacaaactcctaagaagtcttcagaagagatggtgcttcctcaggacaagcagtggccatttcttcttcggtttccggtttcatcttttggtatttgtcttggagttagcagtcaagcaattctttggaaagcattggccacgtctccttccactgcatttcttcacataacccctaaaataaatttcatcctatggttcatctccattgctattgttgctactattttcaccacctatctcttcaaaataattctccattttgaagcagttcgtcgtgagtaccaacatccggttcgtgttaacttcttctttgcaccatggatagcccttttgttcctagctcttggagttcccccatcagttaccaaggacttgcatcaagcagtttggtacattctaatgattccattgttctgccttaagctaaagatatatggacagtggatgtttgggggcaaaagactgctgtcaaaggtggccaatccaacaaatctcttagcaattgttggaaattttgtaggagccttattgggtgcatcaatgggcctaaaagaagggcctcttttcttctttgctcttgggcttgctcactacatggtgttgtttgtaactctctcccagatgcttccaacaaataagaccatcccaaaagacctccatccagtgttctttctttttgtggcaccgcctagtgttgctgctatggcatgggctaagattcagggttcatttcattatgaatcaaggattttctatttcactgccatgttcctatatatttcactggctgtccgggtcaatcttttcagaggattcaaattctcactttcatggtgggcctacacttttccaatgactgctgcagcaattgctaccataacctatacaaatcaagtcacaaatgtactaactcaagctttgagtgtaatattgagtctcattgctacattcacagtaacagcagtgcttgtctcgactatagtgcatgcctttgtcctacgagacctctttcccaatgaccttgccattgccacaagtgagagaaagcaaaaaccacgcaggaaatggctcccatttaagacttgggagccatga

SEQ ID NO: 4253 - DNA, 756 bp, Glycine Max
atgccaacggtattccttttcaacaagcaatctatgatgagtgactttacaaccaaagatattgatgacagggaaagatcatccaaatgggtttcagcattcctctttggacaaactatatcagtgatttctcctgatgtttcatgtgcaagcagctcagcaagaataaatgagatatatgaggttggagagttgtttgatttaagcatccaactaatatacttgatattgctattgggtttgctagggagtgggactttctttgtgattcgccaagttcttgtccgcagagaactcgacctatctgccaaagagttgcaggagcaagtaagaagtggtgatgctggtgcaactgagctttttgaacttggtgcagtgatgctgcgcaggaaattttaccctgctgctaccaagttcttgcttcaagcaattgagaaatgggatggggataatccggatcttgcccaggtttacaacgctcttggtgtgagctatgtccgcgatgggaaagttgacaaaggaattgctcaatttgagacagctgtcaagcttcaaccaggctatgtcacagcttggaacaatctcggtgatgcctttgagagtaaaaaagactacaagtctgctctgaaggcatttgaagaagtcctactgtttgatcctaacaacaaggttgcccggcctagaagagattctttgaagggacttgttgatgcaaccaaaggagttactgtcatcaagtcaacagagaagaaatga

SEQ ID NO: 4254 - DNA, 1134 bp, Glycine Max
atgccaatgcttcgttgcttcttcaacaaagcctttaaagcctccaaatgtgcaaccttgttgcaactcacaattccacgcataaagttgctgagaaacagaagagaggttcatctgaagcagatgcgaagagacgttgctaagctacttgaggctggtcaagaagccaaggctagccttaaggtggagcatgttatgagagaggagaacatcatggctgctcaagacatcattcaactcttttgtgaacttattgctgcacgcattgcatttgttcaatcacaaaggaaatgtccccttgatttgaaggaagcaatatctagtgtatgttttgctgcaccaagatgtgcggatctgccagagttattgcaggttcagtcgctatttgcttccaaatacggaaaggattttgtatctgcagcaactgatctcacccctgactgcagtgttaatggccagttaatagagctgttgtcagttcaagcaccttcacaggaaaagaaactgaaacttctaaaagaaattgctgttgagcataagttagactgggatccaactgcctcagaaaccaagtcctttaaaaaacatgaggacttactgaatgaccccattcaattttgtagtcaatgtgtgtcaaaattgcctcttcctgaagaaaaacacactgaagttgatcttcaatcatcaagccaatctggatcacttggatcagacaaacataaacctaatacttcatttgataaaaaggacagtgaacagtctatgtcattcatctcaactccccttgataataagcttaccaagaaaaatggtgcacatgtgtcagatagcagctttgagaatccattctttgtaagtgttggtaataaatctgaaacagaaagggaacatttcactgaacaaaatgctgcaaatgactatgatgatggtggcataaataatgtggattttccttcatttgatatacccaaggaagattttggttcttccctacacaatcattctgtattggatgacaaatcctctcatcaccagcttaagagattgccttcactagatgattattcgggtttctcatacccaaacttattcaccccaaaaaactcaaataattggtctcatacattcagataa

SEQ ID NO: 4255 - DNA, 1227 bp, Glycine Max
atgcccgcgacggactaccaaggttcgtcttctccttcatcgttaatccattttggccgttcaattctgagtcttcgtcgagaacaggttcactccatttccatggaagggtcaagcttggaggctgagttagaatcctttcagcaacacgtcactaaccggttccttgaactcacttcggttgttcatgatgatttgctttcgctctcgtgggttgggaagctccttcattgcttcttgtgttgccaagaggaattcaaggccattctccatagccacagggctcaggtgttgagaccccctttggatcgcatggtgtctgattactttgagcgaagtgtgaaggctttggatgtttgcaatgccattcgtgatggtattgagcagattcgccaatggcagaagctattggagattgtgccctatgcattggggcatcagaggagcattggtgagggccaatttcgtagagccaagaaggctctcattgatttgcacatcgggatgcttgatgataaggatcccaacgcctcgattgcacatcgaaaccggtcctttggccgcagcactggtagcagggaccatcatagtcatggccatagccatggtcacaataatagcagtaataatacctatcaccatcggtctttggggcattttcgatcactttcgtggagtgtctctcgaacttggtctgctgctaggcagctccaagcaattgggaacaacatttatccacctaaggcaaatgagcttatggcttctggtggccttgcaatgcctgtgttcatcatgaattcgatcctgttgtttgtgatgtgggctcttgtggctgcaattccatgccaggaccgcggattacatgtccattttaccattcccaggaattactcctgggctgctgcaatcctctcgcttcacgaaaggatcatggaggagtcgaagaagcgggagcggaagaattcttgtggcttgcttaaggagattcatcagattgagaaatgtgctagagtgatgaatgatttggctgattctgtccactttcctttgacagaggagaaagaacgggaggttagacagatagtgcaggaggtttcactagtctgtgatgctttgaaaggtggactagaccctttggagcgccaagtgagggatgtgttccatataattgtgcgcagccgtacagaagggcttgactctattggcaggccaagcaatgctgagtaa

SEQ ID NO: 4256 - DNA, 873 bp, Glycine Max
atgccggaatcggagatagggacgccgacggcggcgtcggtgccggcgacgccggatactccgggaggaccgttattcacgtcgctgcgagttgactcactgtcacatgaacgtgagtcgttctcaatggctgggtgcaagtgtctgccgaccaagggccatagctgcttcactgatttctcaatgaacaaacaggttggagcagagtttgtggggactttcatattgatatttgccgcaacggcaggaccaatagtgaacaacaagtacaatggagtagagagtctaatgggaaatgcagcttgtgcagggttaactgtgatgtttatcattctgtccattggccacatctcaggtgcacacctgaatccatccctcaccattgccttcgcggcctttcgccacttcccttggacccatgtcccggcctacatagcagcacaagtctctgcctccatatgtgcatgttatgctctcaaaggtgtttaccaccctttcctctccggtggggtcactgtccccaccgtcagcgtcgcccaggcttttgcaaccgagtttatcatcacttttattctcttgtttgttgtcactgctgtcgccaccgatactcgtgcggttggtgaattggcaggtattgctgttggggctacagttttactcaacattctcatatcagggccgacaagtggtggttcgatgaatccggtgcgcacgttgggtccagccgttgcagcaggaaattacaagcatatatggatctatttggtggcaccaacgttgggtgctctcgctggtgctggtgtttatacgctcgtcaagctgcgtgacgaggaggccgaaccgccgcgacaagttagaagtttccgtcgctaa

SEQ ID NO: 4257 - DNA, 843 bp, Glycine Max
atgcctctcttcatcatcgcatcttatcttcgctgccactgcaacaggatgcatgagttctccattgttgatggttttgtggagataagtgaatgcatggcagagatgaccaagtacgtggctaatgaaccatccgttgggcttttctttatccaacagcatgctcaaaatgcagtacccaatatcatcaaagttaagaaaaatgttgttgagaagtctcatgaaacaactttgcacacagaagatttggaggactctgtcacaatggttcaatcaatgaaagagtgtggatttcccatagctgataagatgatcagagagattaaaaaatctctgataactatggaaacaaaacaaccgaaaagagggttaatccatccagcatcaagttctcattcagaaagagctagtttcttgggtaacgctgcattttatgctcaggagggcaatgaaaaaaggagtaactatttctcaaatgttttgaagtcagcaaaagagaaggctggcagcttcaagtggcggcagcttgatactcggggatcaatagattccacggatgagaagccaccaatgtaccctaatttgccgttgttggtcacatctgcaagcattacttcatcttttcgggctgccgaaactgatgagttgcctgtatcaagccaggttgaagacgagtctcagcacaaacagaccgatgttagtgatatcagcattaatttattgtcagtatcagaaagattcgacgacttcaaagctaataaagaagctaaactagcggagtggctggacggaactggcaaccttgatgataattgcggcacaggtgatgagaaaaggtcttag

SEQ ID NO: 4258 - DNA, 1068 bp, Glycine Max
atgcctgaaaccaccgccaagattcccaaacttatcctccttagggttccggtgagatcccttattctgttcaagtgcgtctgcaagtcatggaaaaccctaatatctgatccccaattcgcaaaggaccacctttgcatttcaaccgccgatccaaacatgactcatcaacgaatagtcgcccgccatcaccgtgatatcctatcattctcggtgcaatcgctgctccaaaacccatcaaatcctgctaaacctcatagctggaggatgagtcacaagtactgcattgtaggttcttgcaatggcttactttgtttgtctcgttttaaacatggttattgcagattgagattgtggaacccttgcaccggattgaaatccaaaagattgtcgatcggcttttaccctgttgatatcactttccatggtcttggctatgatcatgtgaatcacaggtacaagttgctagcaggtgtggtagattattttgaaacccagaccaaaatatattcctttggttcggattcctctactttgattcagaatcagaatttaccgcgtgaacccatcaggatgcaagggaaatttgtgagtggcactctaaattggataattgagaaaggtacaagtgatgatcatcaatgggtgattctttcccttgatatggtgacggagacatttggtgaagtgtttcttcctaaatgcgtcgaggacagtgaaaagatttgtcatcccattctaggtgtctcgcgtgactgtctttttgtttgtttcttagattcgaagaaagctcattggagtgtgttgatgatgaaggagtatggagttcgagattcttggactaaattgttgatgacccctcacattagtatcttcagaacacaatatttatatcccttgtttgagaccttgcgcatttcagaaaatggggttgttctcctgagaacgcgtaccaatttacttctgtataattccaatgacggttggttggtttatcctaggattaggcgcaaacttgggttcgacatgcatatttaccatgaaagtttggtttcaccaaagagttaa

SEQ ID NO: 4259 - DNA, 4383 bp, Glycine Max
atgccttgcagctatgattttaggcttctcattgatccttccacttgtgtcaaccatttgttgaattcttgctttgatgtgttgctgcttatcatgcttgcatgcattatgatccagaaatcatcattaaaaccatctcgtggtctaacacaggtgcaaagatattcatattttcagctagtttctgccatagccaacggtgctcttgggttgacacttttgtgctttggcatttgggttttagaagaaaagttgaggaaaaaccaaactgcgttgcctcttaattggtggttgctagaaatctttcatggattaacatggttgttagtgagtttaacaataactcttaagttgaaacaacttccaaaagcatggtcaaggcctttttctgttctaatcttcttggtttctgattttttctgtgcttcatcagtgttttatgcaattagtagcagagaactatcccttaagatctcttcagatattctatcttttcttggggcgatattattgttattatgcacgtataaggaatccaagcatagggacactgacagtgaaattgatgaaaatctttatgcccccttaaatggtgagtccaacaaaaatgattctattagatatgtaaccccatttgccaaaactggattctttggcagaatgacattttggtggttgaatccattgatgaaaatgggcaaagagaaaacacttcatgatgaagacattccgcggttgcgggaggaggatcgagcagaaagttgttatttgctgtttctggatcaattgaaccgacagaaactgaacgatcaatcctggcagccatcagttttgaggacaataattttatgccattggaaagaaattttaatatcaggattctttgcattgctaaaggtagttgctctgtcttcaggacctcttcttctgaattcttttatattggttgctgagggtaacgagagtttcaaatatgaaggttttgtgttggccatatcacttttctttacaaaaaacatagaatccttatcacaaaggcaatggtacttccgctgccgactcattggtctgaaagttaggtcgttgctaactgcagccatttatagaaaacaattgaggttatccaattctgctagattgatgcactctagtggtgagataatgaattatgtgactgtggatgcttatagaattggtgaatttccctattggtttcaccagacttggacaacaagctttcagctatgtatctcattagtaatactttttcgtgctgttggatgggcaacaattgcctccttggtggtgatagtaatcactgtgctttgcaatactccactcgcaaagttacagcacaagtttcaaagcaaacttatggtgacacaagatgatagattgaaggcttgttctgaggctcttgtgaatatgaaggtgttgaagttgtatgcgtgggaaaccaattttagaagttctatagagagattaaggaatgaggagctcaaatggttgtctgcagtgcaattaagaaaggcatacaacacctttctcttttggtcctctcctgtgttggtctctgctgcttcctttggggcatgttactttcttaatgttccattgcatgcaaataatgttttcacttttgttgcaactttgcgccttgttcaagatccaatcagaaccatccctgatgttattggggtggtcattcaggcaaaagtcgcgtttgctcggattgtcaaattcctggaggcacctgaacttcagagtgtaaatatcacacaaaggtgtctcaatgagaataagaggggttcaattttaatcaagtctgctgacttttcatgggaagataatgtatcaaagccaacactgagaaacataaatttggaggttagaccagggcaaaaggtggctatctgtggagaggttggctcaggcaaatcaactctcttagcagcaattctcagagaagttcttaatactcaggggacaactgaggtttatgggaagtttgcctatgtttctcaaacagcatggatacagacaggtacaataaaggagaatatattgtttggagcagctatggatgctgaaaaatatcaagaaacacttcacaggtcttcactattgaaggaccttgagttgtttccgcatggtgatctcactgaaataggggagagaggagtcaatctgagtggaggtcagaagcagcgaattcaacttgcacgtgcactatatcagaatgctgatatatatctcttggatgatccattcagtgctgttgatgcacatactgcaacaaatttgtttaatgaatacataatggaaggacttgcagggaaaacagtcttgctcgttactcatcaagttgacttccttccagcatttgattctgttttgttgatgtcagatggggaaatcatagaagctgctccgtattaccatttgttgagctcaagccaagaatttcaggaccttgtgaatgcccacaaagagactgctggttctgaccgacttgtggaagttacttctccgcagaaacaatcaaatagtgctagagaaattagaaaaacatctacggagcagcattatgaagcatcaaaaggtgatcaattgattaagcaagaagagagagagaaaggagaccaagggttcaaaccgtatatacagtatctgaatcagaacaaaggatatatatacttctctgtggctgctctttctcacctaacatttgtggttggccaaatattgcaaaactcatggatggccgctagtgttgacaatcctcaagtcagcactttgcaattgattcttgtttacttgctgattggagttatttcaacactattcttgttgatgagaagtctttttgtagttgctttgggccttcaatcatcaaagtctttgttttcacagttactgaactccctttttcgtgcccccatgtcattttatgactccactcctttaggaaggatacttagtagggtctcctcagatctcagcattgtggaccttgatgtcccatttggctttgtttttgctgtgggagccactatgaattgctatgctaatctaaccgttttagctgttgttacttggcaagtcttgtttgtctccataccaatgatttattttgcaatcagcctgcagagatattactttgcctctgcaaaagaactgatgcggctgaatggcaccacaaaatcctttgttgctaaccatcttgctgaatctgttgctggagctgtgacaataagggcttttgaggaggaagatcgtttttttgagaaaaatcttgatctgattgatgtcaatgcgagtccttacttccaaagttttgcagcaaatgagtggttgattcaacgattagaaacagtcagtgctgttgttcttgcatctgcggcactatgcatggttgtacttccacctggaactttctcctctggatttattggcatggctctctcttatggcctttcacttaacatgtccttagtattttcaattcaaaatcaatgcaacatagccaattatataatatcagtggagaggctaaatcagtacatgcatataccaagtgaggctccagaagtaatagcaggaaatcgtcctcctgcgaattggccagttgctggtagagtacaaataaacgaattgcagatacgttataggcctgatgcgccactagtacttcgtggaatcacatgcacatttgaaggaggccacaagattggtattgttggcagaacaggcagtggaaagtctactcttataggcgccttattccgtctagtagagccagcaggtggaaaaatcattgttgatggcattgacatttgctccattggtctccatgatttgaggtcccgttttggtattatacctcaggatcctactctttttaatgggacagtcagatacaatttggacccattatcacaacactctgatcaagagatatgggaggctcttgggaagtgtcagttgcaagagactgtccaggagaaagaggagggattagactcttcagttgttgaagctggagcaaactggagcatgggacaacgacagttattctgtttggggcgtgctcttctaaggcgaagtaggatattggtgcttgatgaagcaactgcatcaattgataatgcaactgatttgattttgcagaaaaccattaggaccgagttttcagattgtacagtgatcacagtagctcacaggataccaactgtgatggattgcactaaggttcttgccatcagtgatgggaaacttgtggagtatgatgagccgatgaacttgataaagagagaaggatcactgtttgggaagcttgttaaggaatactggtctcattttcagtctgcagaatctcattga

SEQ ID NO: 4260 - DNA, 837 bp, Glycine Max
atgcggtcaattcctctgggaacctcagtatctccaactcctataaacacctcaaagttatcacctttcagtgttaattttaagaaaccaaccactttcccatcttggggttcaactcctcctcatgaattctctctctcccaatcaggattatgtagagcaagtcaagttgttgatttgttcccgactgtgtctcctgaaattattgttcgggaggccaggctagaggactgttgggaagtggcagagactcactgcagctccttcttccctgaatattccttcccattagattttgtgctgagaatggacagattggtggccatgatggcaggattcactctaccaaacggttgcaagagaatttgtttggttgccgttactggcaactcatttggtgaaactgtattatttggaagtgaagatttcaaggttggtggttttgatgggaaaatcagcctcaacaagggatatgtggctggtatattaacagtggatactgttgcagactttcttcctaggaaggggccattgcgacagagaaggactggagttgcatacatatcgaatgtggcagtccgggaaaaatttaggcgaaagggaatagctaaacacttggtagcaaaggcagaatcacaagccagaagttgggggtgtcgtgctattgcattgcactgtgatttgaaaaaccctgcagccacaaagttataccaaggccaaggtttcaggtgtataaaggttccagaaggagctaactggccacatccaaagacctcaccggatgtaaagttcaacttcatgatgaagcttctcaacaattcaactgtttctaaatga

SEQ ID NO: 4261 - DNA, 6687 bp, Glycine Max
atgcggttctcttccgagttgttacttgttatggtgcattttcttttggatcttgattcgtggttttgtttcttgttttttatatttttgaatttggcaggtcattttttcagaaagacggtggcggattcgaatgcgccggtgcaggagaaggcgctcgatgcgttgattgcttacttgcgagctgccgacgccgacgcctcgaggtacgggaaggaagtctgtgatgcggttgtggcgaaatgtctgacggggaggccgaagacggtggagaaggctcaggcagtgtttttgctatggattgaattagaggccgttgatgcgtttctggatgcaatggagaaagcaataaaaaacaaagttgctaaagcggtggtacctgcaatagatgttatgtttcaagctttaagtgattttggagcaaaaattgtgcctccaaaaagaattttgaagatgcttccggaactctttgatcatcaagatcaaaatgttcgtgcatcctctaaagggttgactcttgaactttgccgttggattggtaaagatagtgtaaaatcaattttgtttgagaaaatgagagacacgatgaaaaaagagctagaagcagagcttgtaaatgttacaggaacagcaaagcccacacgcaaaataagatctgagcaagataaggaacctgaacaggaagctgtgtcagaggttgtgggtcctggcccttgtgaagaatctgggaatgatgctcctcaagaaatcgacgaatatgaacttgttgatcctgttgatatattgactcctttggagaagtctggattttgggatggagtgaaagctaccaaatggtctgaacggaaggaggctgttgctgagctaacaaagcttgcatcaactaaaagaatttctcctggtgatttctctgaagtttgtcggaccttaaaaaagagacaattaaagatatcagcctatattcagacaaactctgggttatttgatttgcgaaccattgcaataaaggaggagtacaacattaaaattgctagcaacgcaaggaattggaggggcttaactgaagagggcagtgtcaacatgcagtcaatctggtggagggacttaaaaagagccattcagcactctccctatggtataagcctacaacagcaacttaaatggaaggtagaagcaggggataaggtcaaattctgggaagatagatggatttgtaatgaacaatctctagctgaaaagtatcctaggttatacctgattttgtctcaacaacagcagctcattggtcaaatgggggagcacgtaaattcaacatgggagtggcgttttatctggagaagaccactatttgatagtgaaattgacctggccatcactttcctctccgaagttgaaggccaatctattcaccttcatggagctgatagttgggaatgggcagcagatcagtcgggcatctattccactcaaagtgcttatgaagttttatgggaggaggcagcagtggagagtatagaggaatgttttgaggtgttatggaaaattaggattccaagtaagcttattacagatgtgaatattgctgttgcagttgaagctgtccaggctattggcaatcttgctcgtggattaagaactcatttttctgcaagttctcgttttttattgcctgttttacttgaaaaattgaaggagaaaaaacctgctttggctgaggcattgatgcagactcttcaagcaatgcataaagctggatgcatcagccttatagatattgttgaagatgttaagacagccacaaaaaacaaagtccctcttgtgcgatcgttaaccttgacctgggtgactttttgtattgaaacaagtaacaaggttgttattacaaaggtgcacaaggattatgtgccaatctgtatggagtgcctaaatgacggtactcccgaagtcagggatgctgccttttcagcattggcaggaatagctaagtcagttggcatgagacctctggagagatcgttggagaaacttgatgatgttagaagaaagaagctttcggaaatgatttcaggttctgaagatgctgtgcctggtgcttcttctgcagcttctgtgcaaaatacacgcgtaagtgcatcttctgcagagacctctgaaagtgtacttgtcaaaaggtcggcagcaggcatgcttagtggaaagagacctgttcagtcagttcctactgagatgagtcttgaagagattgaaagccgaataggttctcttatagagtcggatactatcactctattaaaaagtgctgtgtggaaggagcgtctagaagccatttcttcactgaaacagcaagtagaaggcttacaggaccttgaccaatcagtagaaattttgattcgtttagtctgcactttacctggatggggcgagaaaaatgttcaggttcagcagcaggttattgaagttatcactcatataagttcaactgcaactaaatttccaaagaagtgtgtagtactttgcctttcgggactaagtgaacgtgtagcagatattaagacacgtgcacatgctatgaaatgtctgagtaccttgtctgaagcagttggtccaggattcatttttgaaagactttacaagatcatgaaggagcataagaatcccaaggttcttagtgagggaattttgtggatggtttctgctgttgaagattttggtgtctcacatataaagcttaaggatttaattgattttcttaaagaaattgggctgcagtcaagtaatgctgcgactagaaatgcatcaattaagttcttgggtgttctgcatagatttgttggtccaggctctaaggtttttctccttgcagacattaaagggtttcttactgatgtaaagcctgcactgctcagtgccctggatacagagtatgagaagaatccatttgagggagcttctgcagttaccaagagaactgtcagggcaaaagactcatcttcaactgttgttgctggtggactggatagcttgcctcgggaagacatcagtggaaagatctcaccaactctcctgaagagcttggaaagccctgattggaaggttcgtatggagtctgttgatgctgtaaacaaaatattggaagaggctaataagcgcattcaagcaactggaactggtgagttgtttggggctcttaggggacgactccttgatagcaacaaaaacattgtcatggcttccttgacagcaattggcaatgttgcatcagcaatgggtcaagctgtagagaaggcaagcaagggtattctgtctgatatattgaaatgtcttggtgacaacaagaagcacatgagagaatgtgtactgaataccttagatgcttggctggctgctgtccatctggataaaatggttccgtatattgcaattgctttgatggactctaaacttggtgcggaagggcgtaaagatctttttgattggttatcgaggcaactttctgggttaagtagttttgctgaagctgcacaactgctgaagcctgcctcttctgcaatgacagataaatcttccgatgttcgcaaggcatcagaggcttgtattaatgagatactgagagttagtggacatgaaatgatcgaaaagatggttaaagacattcatggaccagcactgacactaattgttgagaagttgaaaccatatggagcttttcaaggcacgttctttggttcattcttctttgcgaatgttgagtcatttgagtcaggtagagcagtttcagtgggtgcaatatcaaaagcaaaggctgggaaatcaactgccaatggtgtttcaaaacatggaaatagagctgtatcttctagagttgtggcaacaaaaggtgccaagtctgaatcaatatctgttcaagatatagcggtccagtctcaagccttgttaaatatcaaggattcaaacaaggtattgttggctgaactggagtataccaaatgttgtttaaaatcttataaatatttggttggactgtcatctggattgtcttgcaagcaggaagatcgagagagaatggtggttcgaaggtttaagtttgaggacccacgtattgagcaaattcaagatcttgagaatgatatgatgaagtatttcagagaagatttacataggagactcttaagtgcagattttaagaagcaagttgatggacttgaaatgctgcagaaggcactcccatccattgctaaggaagttatagaagttttggacattcttctgaggtggtttgtgttgcagttctgcaaatcaaacacaacatgtctattgaaggtgctggaatttcttccggaactgcttgacactttgaaggacgaggggtactctttgaccgaatctgaaggggcagtgtttcttccatgcttagtagagaagttagggcataacattgagaaagtacgagaaaaaatgcgggagctgacaaaacaatttgttgccatatactctgcgtgtaaatgtttcccttatatattagagggtttgcgctcaaagaataaccgaactcgaattgaatgtgctgatcttgttggatttattattgatcatcatggtgcagagattagtgggcagctaaagtcattgcaaattgttgcaagtttgactgcagaacgggatggtgaaactaggaaagctgcattaaatacactagctactggttataagattctaggtgaggacatatggagatatgttgggaagctaactgatgctcaaaagagcatgttagatgatagatttaagtggaaggttcgggagatggaaaagaagaaggaaggaaagcctggtgaagcaagggccatttcaaggcgctcagtcagggaaaatgggtctgatgtcgcagaacaaagtggagaaatgactagatctcttgctggtccaatattgaggaaaaattatggtcaacctgatagtaacattgatagacagttgatgccccgtcccatgactgttgctagtggccccacagattggaatgaagcactcgatattatttcttttggttctcctgagcagtctgttgatggaatgaaagttatttgtcatgagttagctcaggccactagtgatcctgaaggaagtgctatggatgaacttgtgaaagatgcagataggctagtttcatgccttgctaataaggtcgcaagaacttttgacttcagtttgactggtggtgcctcatcacgatcttgtaaatatgtgctgaacactctcatgcagacttttcagaataaaagattagcgcatgctgtaaaggagagcacacttgacagtctcattactgagcttcttctgtggctcttggatgatagggttcctcatatggatgatggaagccaattgttgaaagctttaaatgtattgatgcttaagattctggataatgcagataggacttcatcctttgttgtcttgatcaatcttttacggccactagattcatccaggtggccttcaccagcatcaaatgagtcccttgcttccagaaatcagaagttctctgatctagttgtgaaatgccttatcaagcttacaaaggttcttcagagcactatctatgatgttgaccttgatcgcatacttcaaagcatccatttgtacctgcaagacttgggaatggaggaaattaggagaagggctggtgctgatgacaaacctttacgaatggtaaaaactgttctgcatgaacttgtcaagcttcgtggtgcagcaataaagggtcatctttcaatggttcctatcgatgctaaacctcaacccatcatccttgcctacattgaacttaatcttgagactttggctgctgcaagaatgttgactgcatctggacctgggggacaaaaccattggggtgattcagcaaccaataattcagcctcgggcacccattcggctgatgcccaattaaagcaagagcttgctgctatatttaagaagattggagagaagcaaacttgcacaattggtctatatgaactatatcggattacccaattgtacccaaaggttgacatatttgctcagcttcaaaatgctagtgaggcatttcgcacctacattagagatggtcttgctcagatggagaagaatgctgcagctggaagaactccttcgagtttaccgatgccaacccctccaccggcatctttaaatatatcttcccctgattttgcacctctctcacctgtaaacgcaaatccattgggtgatgctaaattaaatgtgaaacctgagccaacaaattttaatttacccccttcatcatacaatgaggagaatagggctgtgaatgccattacttctagagcattaaattctgactatacattaggtgaccaaagaaatgatagatttatgacaggagtaaccagtggaacattggatgccatcagagagaggatgaagagcatgcaattagcagctgctgctgggagtacagaatctggtggtaggcacttaacaagtgcaaatgacaacttcaatcaaggacttcctcctcctagtcagattcctcatgcatcagagcatgttggtactgagaatacaatgcacggtggcgtacttcctatggatgagaaagcattgtccgggcttcaagcgcggatggaaagattgaaaagtggatctcttgaacctctgtaa

SEQ ID NO: 4262 - DNA, 2304 bp, Glycine Max
atgctagtttttgtcatctcttcaaaaggcatttgtcttcagctgttgcttaagtgctgggatattcctattctgggtgtttgcctaggacaccaggcattaggttatgtgcatggagctcaagttgtccatgcatctgaaccaatccatggtcgtttgagtgaagttgagcacaacggctgccagctttttcgtgatataccttctggtaaaaattatggattcaaggtggttcgatatcattcactggttatagattctgaatcacttcctgcagagctcattccaatagcatggacctcttccactagcacacttccatttattgggtccaaagattttggcaagtccaatactcatgaagctcagccagatcaaagcatttccattgatcctcttttagctaaagtaggaaatggaagttcaaaccattttgattatggaaaaactagaagtgcaagagttcttatgggaatcaggcattctacaagaccacactatggtgtgcagtttcatcctgaaagtgttgcaacctgctatgggagtcaaatattcaagaattttagggagattacagatgattattggctgagatttagaaaactttctttagcatgcatgcaggtttcaagtgctaatagactctacagagaggtttgcagaagtattagcacagagaataatgcagtggatcagttaaaagaaatagttcatgcagatagacatttggaatataataaagctgagatgaagcatttagaaatgttcaacatggtaaatactcatcatgcaaccactggttataagtgtttgaagttgaaatggaggaaatttggtcacttggctggtcaagttggtggagcaaaaggtatattttgtgggttgtttggacttgaagctgaaaacaccttttggttggatagttcctccacagagaagggaagagcacgcttttcatttatgggaggaaaaggcggatcactttggaagcagttagtgttcagattgtcccatcaaagtgatgggagttcaaaaggaggtggttatttgtcaactgaagattctcaaggttctgctgaaacaatatttttggaagaaggttttcttgattttttgaacagggagcttcaatcatatcgttatgataaaaatgaatatgaaggcttgccatttgattttcacggtggatatattggttacattgggtataacctcaaagttgagtgtggtgtgaaatcgaaccgtcacaaatctaaaactcctgatgcatgctttttctttgctgataatcttgtagctattgaccacaaaaatgatgatgtttatatattggctatacatgaagaaagttcaagtattacacagtggttgaatgacacagaggagaaacttctgagcttaaatggctctgtgagaatggctttggaaagacaaaagtctcttcctttaactttttcctcatgtaaggttggttttgcagctgaaaaatctaaagagcagtacattgaggatgttaagaagtgtctaaactacattaaagatggagaaagctatgagttatgcctcacaactcagataaggaaatcgattgaggaattgaattcccttgaactttatctgcatttgagagaaaggaatccggcaccttatgctgcttggcttaatttttcaaaggtggatctgagtatttgctgttcttctcctgagaggttcctgcagttggataggaagaatatactagaagctaagcccatcaagggaacgatagctcgtggtgctactgaagaggaagatgagcaactaaaatttaaattacagttcagcgaaaaggatcaggctgaaaacctgatgattgttgaccttctaaggaatgaccttggccgtgtttgtgatcctggatctgttcatgtgccacgtctcatggatgtggaatcatatgcaactgttcacacaatggtgagtactattcgtgggaagaagcggtcagatgtcagtgctgtagactgtgtcaaagctgcatttcctggtggttcaatgacaggtgcacctaagttgagatcaatggaacttcttgattctattgaaagttgttctcgaggtatctactcaggctgtattggatttttctcatataatcaagcatttgatctaaatattgtgataagaacagtcattgtacacgagggtgaagcttcaataggagctggaggggcaattgttgctctgtcaaaccctgaagacgagtatgaagagatggttttgaagacaaaagccccaacaagggctgtgatgcattttgcttag

SEQ ID NO: 4263 - DNA, 1161 bp, Glycine Max
atgctcaccttcgccttcttcctcctcttcttctccggcttcctccacttcccctcctcctctttccctcccatcacgcgccccatcacaaccacgccgtccaaggccgaacccttctccaatctggtcgcggccttcaggcaatgggactcgcaagtggggtgctctcgcttcaaagacaaacccaatggggtgccccttaaccagtcaaaggtcgcgtctttgcaggaagttggcgattgtgggggcttgaaactcaaccatgttagcgttttggtcaaagggtggacttggattcccgataacttggataacttgtactcttgctcttgtggcttgagctgcttgtggaccaaatcgcccgttctcgctgacaagcctgatgctttgttgtttgaatcttccacgcctcctgttcagagacacatgggagaacctcttcgcgtatatatggatcttgaagctgggcgaaagagatcaggtcgagaggacatatatattagctaccatgctgaggatgatgtacaatcaacctatgctggtgcactctttcacaatggtcgaaactaccacgtctccaataaaaaaaacagagatatacttgtttattggtcttcatcacgttgtcttcctcaaaggaatgagcttgccaagaaactcctgagcttactgccacatcattcatttggcaagtgcctaaataatgttggtggtctagacatggctctttctctttatcccgaatgtgcaaacgatgccaacgttacaccaaaatggtgggatcatttacattgtgccatgtctcactacaagtttgttcttgcaattgagaacacttttactgagagctatgtgacagagaagttattctatgccttagactctggtgcagttcctatctattttggtgcaccaaatgtcatggattttgttcctccacattcaataatagatggtagaaaattcaactcattggaagagttggcttcatacgtgaaggcagttgctaatgacccggtagcctatgcagaataccatgcatggagaaggtgtggtgtactgggaaactatggaaaaacccgagccatgagccttgacacgttgccttgtcgattatgcgattctgttagcagaaaaggtggaagaaatgcggcaagctag

SEQ ID NO: 4264 - DNA, 261 bp, Glycine Max
atgctccccttgcacgaagattttgttttgaagattaatttcattgaagatgaacctactcacggatgccactgccatggtgtcactcactcctatctcaagttgcagaacctactcttagatgccattagcgacctcaaggtctccaactttggcctctctgtcttccttgagcacctccgcaacaagctcctccacactgccttgaccgtgccagagatcctctgttttgttgactacgacggcttaatgcctaatcct

SEQ ID NO: 4265 - DNA, 2004 bp, Glycine Max
atgctcggggactcagctgtgctgggagcaggaggaggaggaggtggtggccgcggaggaggagtagaaagtggtgcctccgccgatgcagtggcggcgacggtgaccgtgacacatgatgtggcgacgacaaccggaggaggcggtggtggatcaaataattcgggggacgatgagaggggtagaatcgaagaaggtgaacgtagcttcggcggtaaccggtggccacgacaagagactttggccttgttaaggatacgctccgatatggacgtggcgtttcgagatgcaagtgtcaagggtcccttgtgggaagaagtatccaggaagatggcagagcttgggtatcacagaagctccaagaagtgcaaagagaaattcgagaacgtgtacaagtaccacaagagaaccaaagaaggccgaagtgggaaacaagatggcaaaacctatcgtttctttgatcaactacaagcccttgagaaccactctccaacaccccattctcccaacccttcaccaaaacccccacaatcagcaccatcaagagtagtagcatcatcggtgtcactaccaattgcaacaacaacaacagtgtcactaccaattccaacaccaacaacagtgccaatgcagcctatattgtccaacaacgctatactcactagtagtgtccccaatatcactgttccatcaacaacaccactccctataaccattcctcaacccattctcacctccccatcaataaacctcacaatcccttcttaccctccaacaaaccctaccaatttcccaccaccaccaaaccctaccctaccatcctctttccccaccgacaccttctccaattccagctcctcctccacctcctccgaggaaacattggaagggagacgcaagaggaagcgcaagtggaaagatttcttcgagagactaatgaaagaagtgatcgagaagcaagaggagctacaaaagaagttcctggaagccatagagaaacgcgaggacgacagaatagcaagagaagaagcatggagagtacaagagatgaaaagaatcaatagggaaagagaaatcttagcacaagaaagatccatagccgcagccaaagacgcagccgttatgtcattccttcaaaaaatagccgaacaacaaaacctcggtcaagtatcgaccaacatcaacctcgtacaacaaccacaacctcaattacaaccgcagccaccactacaacaacaagtgacacaacctagtattgcagcagcacaacctcccgtacaacagccaccgcccgtggttgttacacagcccgtggtgctgccagtggtgtcacaagtgacgaatatggagatagtgaaagccgataataatagtaacaacaataataacggcgagaatttcttggcaccaagttcttctcggtggccaaaagtggaggttcaggcattgataaagcttcggacgagcatggatgagaagtatcaagagaatggaccaaagggtcctctctgggaggagatctcagcctcaatgaagaagctcgggtacaaccgaaacgcgaaaaggtgcaaagagaaatgggagaacatcaacaagtacttcaagaaagtgaaggaaagcaacaagcggagaccggaagattccaagacgtgcccttatttccaccagctggacgcgctgtacaggcagaagcacaggggcgaagagagccccgcggcggtggaggcgaagccggagagcgcggtggcgccgttgatggtgcagccggagcagcaatggccacctcagcagcagcagcaggatagggacatcacaatggaagacatggagaacgaagatgatgaatatgaagaagagagggaaggagaggaagaattagaggatgatgaagatgaagaggatgaagaaggtggtggtggtggtgggaactatgagatagtggcaaacaaaacaagtggtggtggtggtgcttctgctgcttcagtgggggcttcaacggagtag

SEQ ID NO: 4266 - DNA, 660 bp, Glycine Max
atgctctccgttctatcaaagcctccttcacacttttttttgtttcaattttccatttttgtaggacggcaatgcaaacctttaatattcaaaccaaccaattttggctttggggtctggaaaagttcaaagtatcacactaaaagaaatgtcaatgacaattccggagtcatgcaatgttgctcatgctacacagaagttggagcttctgctggcataacaatatcctcactagtggatgcagccaccacacagatatctcttaattcagatgtagacttgaatactctcaaactgagcatgccagaaacttcacacgcttcctcagatttcatgacaagattggttcttgcagatcttgaccctgctactgcaaagttggccattggatttctaggtcccttcctctcagtgtttggttttctctttatagtaagaatagtcatgtcttggtacccaaaactcccagtggggaaatttccatatgtaatagcctatgctcctactgagccacttctcattcctacccgcaaagtgattgctcctcttgctggtgtggacgttactccagtggtctggtttggattaatcagttttcttaacgaaatattagtaggtccacaaggattactagttctcctttcccaacaagtcaattag

SEQ ID NO: 4267 - DNA, 168 bp, Glycine Max
atgctgcaattgcttggcatgaggatagaacaaaatgggttggtgataagtctcaacatccaccaagaacagctaaggatccaattattagctggtcaacatcatatgaagagctgctgtcaactaacgaaccttttgctgagccaatacccttaccagagatggtag

SEQ ID NO: 4268 - DNA, 613 bp, Glycine Max
atgctgcagttgactagcaatattgtagcctctacaggaatctggcttcctgttaaggaactgaaaagaatggtgaaatttaggatctgggttcttatcgttaggaatgaagctttagttatttggactaaatttccatattctcttcgattaattaacattgatgcatacatgagaatcgtaaaactcagttgtcattattggaaaaaaacattattctcagtttttttccttcttatttgttgttttcaatcttgcttcgaaaatgacttggaagaagtgataggcaaaggcaaaccagttgaagaatctgatattgttaaactcccttacttgcaagcaatcataaaagagactttccgtttgcaccccccagttcctttcttactccctagaaagacagaaagagatgtggacttgtgtggcctcaccatcccaaaggatgcacaagtcttaattaatgcgtggactattggtagggacccaaccttgtgggacaatccaactttgttctcaccagagaggttcttggggtcaaacattgatatcaaaggtcgaaattttgtgcttactccatttggtgggcgcatatgccctgcattaatgttaggat

SEQ ID NO: 4269 - DNA, 825 bp, Glycine Max
atgcttctgagacattatttcatcaataagatgcatgagttctccattgttgatggttttgtggagataagtgaatgcatggcagagatgaccaagtacgtggctaatgaaccatccgttgggcttttctttatccaacagcatgctcaaaatgcagtacccaatatcatcaaagttaagaaaaatgttgttgagaagtctcatgaaacaactttgcacacagaagatttggaggactctgtcacaatggttcaatcaatgaaagagtgtggatttcccatagctgataagatgatcagagagattaaaaaatctctgataactatggaaacaaaacaaccgaaaagagggttaatccatccagcatcaagttctcattcagaaagagctagtttcttgggtaacgctgcattttatgctcaggagggcaatgaaaaaaggagtaactatttctcaaatgttttgaagtcagcaaaagagaaggctggcagcttcaagtggcggcagcttgatactcggggatcaatagattccacggatgagaagccaccaatgtaccctaatttgccgttgttggtcacatctgcaagcattacttcatcttttcgggctgccgaaactgatgagttgcctgtatcaagccaggttgaagacgagtctcagcacaaacagaccgatgttagtgatatcagcattaatttattgtcagtatcagaaagattcgacgacttcaaagctaataaagaagctaaactagcggagtggctggacggaactggcaaccttgatgataattgcggcacaggtgatgagaaaaggtcttag

SEQ ID NO: 4270 - DNA, 825 bp, Glycine Max; identical to SEQ ID NO: 4269

SEQ ID NO: 4271 - DNA, 4302 bp, Glycine Max
atgcttgaagatgatagtcggccgtcgatctcgcgcggtgatggaaagtatggcaggagcagtagggaaaatagaggaggaccctttggtcagagagattggcgagggcattcgtgggaacccaacaatggttctatgaattttcccaggaggctgcaggatgtgaacaatgaccagaggtcagtagatgatgccctagcatattcctctcatccacattctgattttgggaacgcttgggatcagcaccacttgaaagaccagcacgataagatgggtggtgtcaatatgttcggaacaggaccaagaagtgatagagataactctctgggtgactggaagcctcttaaatggacccgctctggaagcttgtcatctcgaggctcaggttttagccactcaagtagctcaaggagcatgggaggagcagattcccatgaagtgaaggctgagttgctacccaaaagtgtggctgctaatgagtcgcattcaggggaagctgctgcttgtgcaacatcttctgtgccatccgaggatacaacttccagaaaaaagcctaggctgggttggggcgagggacttgcaaagtatgagaagaagaaagtcgaggtgcctgatgcaagtgcaaacaaggaaggtcctgtcttgtctactagcaacacggaaccttgtaatctcctcagtcccagcttagttgataaaagcccaaaacttttaggattctcagaatgtgcatctcctgcaactccatcttctgttgcctgcagttcctcacctgcaggtatggatgataaattatttgggaagactgcaaatgtggacaattatgctagtaatttgactggttcgcctgctcctgtgtctgaaagtcattttgctaggttttcttttaacttagagaaatttgatattgactccttgaataatttgggttcttcaattattgagttggtacaatctgatgatccaacttctctggattctggtccaatgaggtccaattcaattaataagttactgatatggaaagctgacatttcaaaggtgttggagatgactgaatctgaaatagatttacttgaaaatgaactgaagtcactaaaatctgaatctggggaaacatgtccttgtccatgtccagtaaccttgggctcccagatggtaggtagtgatgaaaaatcctgtgaagaacatgttggggtctctgatcaggtcatccggccagtaccgttgaaaattgttgatgatcccaatacggagaagatgcctctttcaactaatttacatagtattcatgaaaatggcaaggaagaggacattgatagggacatgataacttctcccgggacttggatactgttctgtctacagctgaaagaagctagtgtgcctgcttgtgttgatggcaatatctctatggagctaaaggatagcatggatattttatataaaacaattatttcttccaataaagaatctgccaacagagctagtgaggtatttgataagttatggcctaaagattgttgcaagattgaaaagatggaagcaagcagtgacgcatgcactcataccttcatcatggaaaaatttgctgagagaaagcaatttgcaagatttaaggagagagttattgcacttaaattcagagccttgcatcacctgtggaaagaagatatgcgcttactgtctatcaggaaatgcagaccaaaatctcacaaaaaaaatgaactaagtgtgcgatctacctgtaatggtatccagaagaatcgatcatccattcggtcacgtttcccctttcctgcaggaaatcaactaagcttggtttcaacatcagagataatcaattttacaagcaaactgctttcagaatcccaagttaaagtgcagagaaacaccctgaaaatgccagcattaattttggatgaaaaagagaagatgatttccaagtttgtatccagtaatgggttggttgaagatccattggctatcgagaaagaaaggactatgatcaatccttggaccccagaagagagagaagttttcttggagaaatttgctgcctttggaaaagattttcggaaaattgcttctttttttgaccacaagacaactgctgactgtgttgaattctactacaaaaatcataagtctgattgttttgagaaaattaagaagcaagatggtgataagcttgggaagtcatattctgccaaaactgacttgattgcatcaggtaaaaaatggaaccgtgaattgaatgcttcttcgcttgatattttgagtgcagcctcattgatggcagatggcattgcagtgaagacgtataggggtgaggacttcatagagaaatcaagcagttttgacattcttggggatgaaagagagactgctgctgcagctgatgtattggctggtatatgtggttctctttcatctgaggctatgagttcctgcataacaagttcagtggatcctgtagaaggtaacagggataggaagttcctgaaagtaaaccctttatgcaaactgcccatgacacctgatgttactcaagatgttgatgatgagacttgttcagatgagagctgtggtgaaatggatccaacagattggaccgatgatgagaaaactgcttttcttcgggctgtatcatcttttgggaaggattttgccaagatagcacggtgtgttgggacaaggtcccaggaacagtgcaaagttttctttagcaagggccggaaatgccttggattagatctcatgcgcccaatacctgagaatgttggatccccagttaatgatgatgcaaatgggggtgagagtgacacagatgatgcatgtgttgttgagacaggctcggtggaaattaattggacagaagtagatcttgaagatgcaaatgtcacttctggtgcttgtcaaatcaatattgattctaaacagggctgtgatggtagtgaagttttcttgtgtggttctaacaagtctggatctgttggtgaacgagcagatataattatgtcagatagcacagaagttgaaaatgataaagcaaataaattgggaggtgcagctacagaattgatttctgctccaaatacaagggaaccatgccagagtaattccattgctgaggatagaatggtggtttctgagaggcatagagtgtcttctaccctatgtgttgatgatagagataataagcatgaagctgattcaggtgttatagttgatatgaaaagctctgtgcatgatttaagcactatgataaattcttcaatctcatctttgggcaattcttgttcaggattgagttttagttctgaaaataagcatgtgccccttggaaatcctcgtgtctctgcattccaagatcaaatgtcctctacttgtgatattcggggaggtagagatatgcactgtcagaattccattagcaatggtgaccatcagcatattactgggaatttatcagaccacgttgatgctgttagcattctccagggatatcccttgcaagttcctgtgaagaaagaaatggacagtgatatgaattgcaccagttcagcaactgaattgcctcttctgccccaaaagattgaacatgatgatgatcatatcaaagcattccagtcgtcagattcagataaaacattcagaaatggtgatgtgaaactgtttgggaagatactaaccaatccttcaaccacccagaaacctaatgtgggtgctaaagggagtgaagaaaatggtacccatcatcctaagttaagcagcaagtcttctaatccgaaaattactggccatcatagtgctgatggaaatttgaaaattttgaagtttgaccataatgattatgttggccttgaaaatgttcccatgaggagttatggttattgggatgggaacagaatacagactggtctctcgacattgcctgattctgccatcttgctagcaaagtatcccgcagccttcagtaattatctcacgtcttctgccaaattggagcaaccacatcaatggcagcaatgctttgatcgattatcagatcactgccaagatgtattctctgagatgcagagaagaaatggtttcgaagcaatctcaagtttacagcagcagagcaggggaatgaatggtgttggaagaccggggattcttgtgggaggatcttgcagtggggtctcagatcctgtggctgcaatcaaaatgcattattccaattctgacaagtatggtggtcagactgggagtattgcaagagaggatgaatcatggggagggaaaggggattga

SEQ ID NO: 4272 - DNA, 153 bp, Glycine Max
atgcttgttgatggagccaatgcacggaagaattctgtgagcaccattcctcattcttcagtgcctggaaatcccgctgtctcaatgtctccaactagtcttaatattggaatggacttgtgggacctgctggtgccgaagctgcaaaaatga

SEQ ID NO: 4273 - DNA, 1320 bp, Glycine Max
atgctttatggagaaatcaaggttctggggtctctcacgagtctcacttctctcaatatctcctacaacaacttctcaggtcctatcccagtaactccattcttcagaactttatcttctaattcatatcttcagaacccccagctttgtcagtccgtggatgggactacatgttcttcaagcatgattcgaaaaaatggtttgaaatccgcaaaaaccatagctttggtcacagtcattctagcctcggttactataattctcatttcatcctggattctagtaactcgtaatcacggatacagggttgaaaaaacactgggggcatcgacttccacatcaggtgctgaggatttctcttatccttggactttcatcccatttcagaaaataaacttcagcattgataatatcttggattgcttgagggatgaaaatgtcattggaaagggttgctcaggtgttgtgtacaaggctgagatgccaaatggggagttgatagcagtgaagaagctatggaaagcaagcaaagcagacgaagcagtggattcttttgctgcagagattcagattcttggatacattcggcacaggaacattgtgaggttcataggttattgttctaacaggagtattaatcttcttctctataactacatcccaaacggtaatctgcgacagctgttacaagggaacaggaacctagactgggaaacaagatacaagattgctgttggatcagctcaaggtctagcttaccttcaccatgattgtgtccctgcaattctccatagagatgtgaaatgcaataacatactcctagactccaaatttgaggcatatctggccgatttcggtcttgcaaagctaatgcattcaccaaattatcatcatgcaatgtccagagttgctggttcctatggttacattgccccagaatatggctactccatgaacataacagagaagagtgatgtctatagttatggggtggttttgctagagatactaagcgggcgtagtgctgttgaatcccatgttggagatggtcaacacatagtggagtgggtgaagaggaagatgggaagctttgaaccagctgtatcaatactagacacaaagctccaaggtctgccagatcaaatggtgcaagagatgcttcaaacacttggcattgctatgttttgtgtgaactcttccccggcagagcgcccaacgatgaaggaagtggttgcactactaatggaggtcaagagccagcctgaggagatgggcaagacctctcaacctctaataaaacagtcctcaaatcaaagctga

SEQ ID NO: 4274 - DNA, 858 bp, Glycine Max
atgctttgctgcagatatgtttctgctcagaggtactgtgaagcattagatatcctacattcaggagcgtgcattcaattgtctcatgggcaggttacctgtggagcagagctagctctattgtttgtggagacattagggaaagggaaaattccttacaatgaggaaattcttgaacgtctcgacaaaatttacaaatcatttcctcgggtttcattgccacaaaacctatgggatgtcgatgacatgcagcagctttctgaaaacattggaagtgcaaagacacgtgttgagggctgctcctcattcttaaaagctgctatcaagtggtctgccggaaatggagtaaataagaatggatctccagagctgcacatcatgctagctgagtacatattttctgaaagtcctgaggtggatatggctaaagtgacacatcattttgtgagaggaaataatccaaagaagtttgcttctactctagtgagttttttgggcaagtgttatcctggtgaagatgatttggccattgctcgggcagttttaaggtacttgtcttcaggtaatttgaaagatgcgaacatactaatggaagagataaagaagcaaactgaatcggctgaggttgcatttcctaagacagagttgatgcaatttatcgcatatcttttgcaaacgttggagagagatgctttgcctctttttagtatgttgagagcaaattttaagccaagtattgagagggagcctgcgttcaatgagatgctagatgatattgcggagaggttctttggagtacagcgaaggaaccccatgggaatgtttggagatatattcaagttgatgggagctgagtaa

SEQ ID NO: 4275 - DNA, 1977 bp, Glycine Max
atgctttgtctcttcctcctcctccttcttcttctcttcaccttcccctccctcgttctcaccctccctttcttcccctctgataacctcaccctctacggtgacgccttcttcacccgcaacgccatcaccctcaccacccaacactccaaatgctcctcttcttccatcggaagagctttcttcatctaccccgtccgttttcttgacccgcaaacaaactccaccgcctccttctcctgccgcttctccttctccatcctctcctccccttcttgcccctccgccgacggcctcgccttcctcatcgcctcctccacccacttccccaccctctcctccggttacatgggcctcccttcctcctccttctcctctttcttcgccgtcgaattcgacaccgccttccaccccttccttggtgacatcaacgataaccacgtcgccgtcgatgtcaacagcctcgcctcctcattcgcctcagtcgacgccgcgtcccgaggcgtcgacctcaagagcgggaaaatcatcactgcatgggtggagtataggcatgcaatgagaatggtacgtgtgtggatcggctattcctcaactagacccccaactccgattcttgctacccaaattgacctttctgagagacttgaggacttcatgcacgttggtttcactgcctccaacggagaagggtcgagtgttcaccttgttcatcattggcagttcaagactttcggctatgatgatgattctcgctccatggatgacgacattgagaggaggaaaaagattggggagatggctcttgggttggcagggttgacggcgtttgtggtgtcgggtttggcggcaatggttgtggtgtgtgttttcttgacaaagaataaagcttgtattaggaagaagaataaggaagaacaagggcaaagttgtaggtttcagacgagtaaagtgccaacaaggttgtcactttctgacattaagtctgctacaatggggttcaatcgagataggcttgttggggagggtgcatctgcaaaagtgtataaagggtatcttccttttggaggagacgtggcagtgaagagatttgagagagataacggtttggattgtttgcacaacccttttgccacagagtttgccaccatggtgggttacttgcggcacaagaatttggttcagctcaaggggtggtgctgtgaggggaatgagttggttctggtttatgagttcctccccaatgggagcctcaataaggttttgcatagaaacttcaattcttccattgttctttcgtggcagcaaaggctgaacattgttctcggggttgcttctgctcttacctaccttcatgaggagtgtgagaggcagatcattcatagggatgtgaagacatgcaacataatgcttgatgctgatttcactgccaagttaggggattttgggcttgcggaagtgtatgagcacagttctagcacgagggatgctactataccagcagggacaatggggtatcttgctcctgaatatgtttattctggtgttcctactgtgaagactgatgtgtacagctttggggtggtggtgttggaagtggcaactggtagaaagcctgtggaggatgatggcaccgtggttgtggattttgtgtggggtttgtggggaaagaggaagctcattgaagctgctgatccaagattgatgggaaaatttgatgaaaaagagatggaaaggatgttattggtggggcttctttgtgtgcaccctgattatgagaagaggccaagagtgagagaagcaacaagaattcttaagaaggaagcaccacttcctttgttgccaaccagtaaaccaagggtgagaattaggcctatttgtcctgatgatgatacctctgaagcacagagtgttgttgcggattggctcagcacagatgatgctccttatttgacccctagaagccagttttactag

SEQ ID NO: 4276 - DNA, 4074 bp, Glycine Max
atggaaaacaataacaacaatgaggaagctgaatattctcttcctgatgatttggatgtccaaacttgggaacctcctgagccagaaaacccacaggatgatatggaaaatagtgtgacttgtaatgacgacgatgaagaccagggcctagggattgcaaactggggtgagcctacctctatgagtagttctgagaatgaattaagtgggagctataggttcaaagaggaaaaacaaagagcaatggaagaagtaatgaatgggaaattcaaggcacttgttggtcagcttcttaaatctgtgggagtttcctcttctgatcaatgtgataagagttgggtggacatagttacatctttatcatgggaagctgcttcttttttgaagcctggtgccattggagctaatgcaatgaatcctgatggatatgttaaagtgaagtgcattgctgctggttcccgcagcgaaagtcaactgatcagaggtttggtcttcaaaaaacatgctgctcacaagcatatgcctactaagtataaaaatccaagattattactgatcagcggtgtgcttggccattctatcaatgggctgtcctcatttgactccatggaccaggagaaagatgatctgaaatctaaaatggatcgtatagaaatgtgtcatccaaatgttatattagtggagaaaactgtttctcgtgatatacaagagtcaattttggcaaagggaatgacacttgtgcttgatatgaagcttcatcgtctagaaagagttgcatgttgtactggttcaccaattttatcatgcgataatttgaacggtcaaaagctaagacactgtgactttatctattttgagaagtttgtggaggaacatgatgctgttggtgaaggaggaaagaagcccatcaagactttgatgttcattgagggctgtcctacacgtttgggctgcacgattttactgaaaggtacacacagtgatgaactgaagaggatcaaatgtgtcatgcggtgtgcagttgtcatggcatatcatttaatccttgaaacctcctttcttgttgatcagaaagcaatgttctctaccattcctgctgtgagtgtagcagatatcttgccaactgataaaaaatcctgtgatttagcatccactaattcaagcattccatctcttgagtattctgctgagaatggaatagttagtactgatattcccatatgcaatggacttcatgaaaacaacatcaatggtttaaacctaggatcagaggagttttctccattctcttgtgaaccatataatccagccgtattttctgggttctcagctatttcatcttctcttaaaaagttacttaatggtggacaatccctgtcttcacctgtgcatttagattccaatggggatataagtaaatatgatgaaaataatagaaaagaactccaacgtaaagatgatatcaatgcagtgttggattctcagagtattttggtcttgatgtctagatggaatgccttaagagggactgtatgccagcaaagtcatttttcacatattatgttctacaagaattttgatattccacttggaaaatttctggaggataacttactcaatcagacaagactttgtgatgcctgtcaagaattgccagatgcccacttttattattatgctcatcacagtaagcagcttactatccaagttaaatgcttgccccaggaaaaaagtttgcctggggaggcagaagggaaaatttggatgtggagccgttgtcgaaaatgcaagtctggttctacaaagagagtgctgatatccaccactgcccgtagtttatcatttggaaaatttttggagctcagcctttcttactattcttctagcagaaaattgagttgtggacattctcttgatagggattttctctatttctttggattaggtcacatggttgcaatgttcagatattcttctgttgccacatattctgtgtgtatgcctcctcgaaagctggagttctgtggtgcaataagacaagagtggcttttgaaagagactcagaatgtgtatatgaaaggcataacattattcaccgaagttgcaaactgtttgaagacaatacaatttgatggccttggaggatcaattagagatttgtctgaagttgagaagatgttcaagcaagagcaagaagaattcgaggcaaacatcaagactgctgttgctaaaaaaggggatccagaccaggctgccttcaaacttctcagtttaaaccgattgatgtgggatcttttgcttcaatcctatgtgtgggtccggcgcttgtacccattacactcacctgatggtttaagacttgaatctgatgtctctgagaaagttatgcatgaacatgattattcaaaggtggaaggtattgctagtagagaaactgggtctatgggtaattttatggaagatggggatgccaatgtaaaaattatgtttggctcatctgtgcaaaatgagaggataccgattgttgatgatttgagatcaagaagatcttctgaccaaaacttgaatttgagtgaaaactctccagtttctacagatattcaaactaatcatttggttgctgatttaaaggtattaaacaaaatttcttcctttcattcaccaatttccaacatgctggattcaaatgattggttctggaagccatttgctgacattcgacagataggcataaaggaattccagaaaagattattgccaaaatttgaatttgtaagcagctctattgctgaatatatacccacagcccatcaattaatcactgaggaaggtacaaggttgcatatccctctcaagactgacaatcatgttgtgtctgacttcgagggtgaaccctcaagcataattgcttgtgcactggccttattgaaagatgcatatgaggtgtcagaaattgatgatgaggatgagagaaacgaaagtggaataacttcaaactcaacagaatgtttgcatggcttgaccaatggtgctgccttaacttcttcacactcattttcaagaagttcttcagattcagattctgtgcattctgcaggaagcacttcttcagaagagtcacgagcctctcgtgctacagaaaaccatagcatagagattgctatgggttatgctaaatcacttgggagggaaaaatattcagtgatatgtcattattttaagcagttccgtgaacttagaaattggtgttgcctatctgagcttgattttattgcttctttaagccgctgtaggaattgggatgccaaaggtggaaaaagcaagtcctattttgcaaaaacacttgatgacagattcatcataaaggagattaagaagacagaacttgattcatttttggggttttcttctctgtatttcaaacacgtgagagaatcatttgagtctggcagccaaacttgtcttgcaaaagtcttggggatatatcaggttactaaaagacacgttaaaagtggaaaagaggttaaatatgaccccctcatggtgatggaaaatcttacctacaatagaaatattactcgccagtatgatcttaaaggtgctctttatgcccggtacaattctgctgctgatggagctggagatgttctgttggatcagaactttgtgaatgacatgaactcgtccccattatatgtcagtcttaaagcaaagcgttatcttcaacgtgctgtttggaatgacacatcttttctgaattctatcaatgtgatggattactccttgcttgttggagtagattctcagaagagcgagcttgtctgtgggatcattgattatctcaggcagtatacgtgggataaacatcttgagacatggatgaagtcttcacttgttgtgccaaaaaatgtgttgccgactgtaatatctcctaaagaatacaaaaagaggttcagaaagtttatgtctacatattttttgagtgttccagatcactggtgttcccagaaatcctccaatccttgcaaactttgtggctcaggggaagatgacccttctcagcaaaagccctag

SEQ ID NO: 4277 - DNA, 408 bp, Glycine Max
atggaaaacctttcaccattgatttacaaaaaccccattagaagaacttctaggcgatctacaatgtatcttggtgtgagaaaaaggccatggggaagatatgctgctgagattaggaacccatacaccaaagagagacactggctaggcacatttgacactgctgaagaggctgctatagcttatgatctttcatctatcaagatttgtggcattaatgctcgaactaattttcactacccttttgtgtctcttccaccacttcctatgtcgtcattgcctcctccaccgccaccgccgaccccagagttggatccaagtgttgaagtttgtctagagatgatgaatgctgcttcttacgatgtttttctaattctggctatggcctgcctcttatcaaatcaataa

SEQ ID NO: 4278 - DNA, 1017 bp, Glycine Max
atggaaactgtttgtctccactgtggcgacagaggctttccagagacattggttttttgcaccgaatgtatggcttatgcgctgcataggtactgtttaaaggggcttgtgaattttactgatgctgttacatggttttgcgaggattgtgcaacaaagcttggggtgccacctgctcttgaccaatctacacctatcgcatctgtaacaagagaaaattgcatacagggagtgaaaaaacacaataaacagcgaaaaaagaagattacaaagaagcagattgaaggaaaagctaacgctggcttagttgctaaaacaaagggtgtgttatctgctagtcacagttcatctgagcctgagcatcctcattgtagtaacagaggcgaagaagaacatgaggtgaaaaatgactgtggaccagttccaagggatgtagctaattttgatgtaggtgaagaagaaagtgtggcaagggatttagctaattctgatgtaagtttcaaatctgttccagtttctcaaggagctaccaatagtgattcaggttgtgtagaagtagatggtcatgtttatgcacagcctactattgatccaatctggaggggaagtatgtacttttgcaatggaacaattcgtactgtcagtggacttctggctcatatctccaatttagcgtgctcccaagttgcggaggagacaggacatttcccagaagtgcttcatgcagaatttcttcccagagataaggtgtgggctgaaagtttcaagaggggggatccaactgatcaggacattgctctttttttctttcctgacagtgaaggatctgaaaaggacttcgatgtgctggttgaagatatcatgatctgtaaacatgtcataagatttgtgggtaaaaatgcagagcttttaatttttccttctactgagcttccagtccaaaattggagatatgaagccaagtattatttgtggggtgtcttcagaaagaaagcaaacttaagaagagacaaatga

SEQ ID NO: 4279 - DNA, 672 bp, Glycine Max
atggaaacttctcagcctctttctatagaaagcttctcatacagttggttagtgaacctaaggccatcagcactagaaagcctagaaagctccctaagaactccccttgatgcatctgatgaaacttcttccttcattgagatggacccaagaatgccaccttctaaaagattctttaagaactcacaggactccaaatttgacttcccaatttcacagtcccctctcactcttgtccatgcagatgagctcttttccaatggctacctcatgcctctctttgttgagtcattgcaaatggaagaatatgagtcctcagactccaacacaagcttagtttcatcatcttcacatgcaccaaagagtgaggctcctacaggcccttctagatgcctttccttaaaaaagtgcagaacattgtcaaggagagtgtttcagaagtatctgaatttcttgaggcccttgtgtagaaagctgagggttcacaagcctagtattgatgctgttgctaagagaggtgaggctgtgaagaataggagatactattcagacactgctacttcaccgcgaattagtgtagccttttctgctgatgattggcgctactcttgtgattctgaaagctcaatatatgaagcagttctccattgcaaaagatccatcggagaatga

SEQ ID NO: 4280 - DNA, 1341 bp, Glycine Max
atggaaatcacaattacatcaagagaaacaatcaaaccattgttccccacaccagatgaacacaaattcttccaactctctttgtttgatcagcttcaacttgtcacctatttgccaatggttatgttttaccccaacaaggtggggttccctgaaccctctcatatctgtgctcaattgaaacaatcactgtctgagacactaacaattttctaccctgtagcaggcagaagagaagaccacactttcatcacttgtaatgatgagggtgcactttacttggaagccaaggtgaaccttaacatggttgagttcctcacaccacctaagctagaatttctaaacaaattgctcccacgtgagcctaacaagatgcactcacatagagaaaccttgccccaagtacttttacaagtgaacatattcaattgtggtggaatagctataggcacatgtaatctccatactcttcttgatggttgctctggaagcctctttcaaactacttgggccgctatatgccgtggctctaaggaggaagttccatctcctgatttaagttctgcctcttctttctttccaccattgaatcatttgagtttgcataaccatgctaatcaaaataatgaggattcaagtgcacaaaaaatgtgcaccactagaaggtttgtgtttggtgttgaatccatcaacactctaagagctgaagcaaaagacggtgattatgatgaaagctcaaagcctcttaccagatatgaagcactgactgcattcatttggaaacacatgacacttgcatgcaagatggagtctgatagcacaagaccagcagtggctatccatattgtggacatgagaaggaggattggtgaacctttctctagatacaccattggtaacattttgtggccagtgatggtgttttctgaaacagtcaatgcagacactagtgttagatatttggtcagcattgccagggagaaatttggaaagctttcaagggagttgtttttaagagtgaaaagtgatcctaatatcctagggagcactcagtgtgtggatctgcctcaaggtattgaaacaataagtccaattccaattgtgctgacaagttggtgtggcttgaatttcagtgaactagattttggttttgggaagcctttgtgggttggtgttagaggaggggatcaggaaactctccccaatgtagctgttatcatggaaacagatgaaggcatggaagcttggttgacaatggaaatgcaacatattgctaacttggaaagagacgttgagtttctcagattagctttgcctaatcctagtgtttcaaacatctag

SEQ ID NO: 4281 - DNA, 1107 bp, Glycine Max
atggaacacgccttacaagccgtcgtcgcctctatcgccagcttcttcgtggtcaccctccttctcgccgccgccatcctcctctgccagcaccaccgcaactccaccaagacccgggcccgctcctcccatatccgaacccgccccgccccccaccgcgaagcctcctcctccctctccgccgtggacgccagctggtcctccgaccccaacctcatcaagatctcctgggacgagctcgcccgcgccaccgacaacttctcccctcacctcatcgtcggcgacggcagcttcggcctcgtctacaaggcccgcctctccagcggcgccaccgtcgcagtaaaaaaactctcccctgacgccttccaaggcttccgcgagttcaccgccgagatggaaaccctaagccgcctccgccacccaaacatcgtcaaaatcctcagttactgggcctcaggccctgaacgcctcctcgtctacgagttcatcgaaaagggaaacctcgaccagtggctccacgagcccgatctctctctctccctctccccacttccctggcccacacgtgtcaacatcatccgtggcgtggcccatgggctttcctacctccacggccttgacaagcccgtcattcaccgcgacataaaagccagcaacatcttgttggactctaagttccaggcccatattgctgactttgggctggcccgtagaatcgataaaacgcactcccacgtgtcaacgcagttcgcgggaactattggctacatgcctcccgagtgcatagaagggtccaatgtggctaacagggaggtggatgtgtatagttttgggattttgatgattgagaccgcgtcgagtcacaggcccaatttgccgatgaaattgggcccggacgacattggtatggtccagtgggccaggaagatgaaggagaagaatgcggagatagagatggtggatgtgaatatttcaagaggagaagggttgagggaggagactgttaaggagtacgtgcgcatcgcgtgtgagtgcacacgtgagatgcagaaggaaaggccccaaatgccacaagttgtacaatggttggactccatgccactttga

SEQ ID NO: 4282 - DNA, 2325 bp, Glycine Max
atggaacagaaacacgtgttgttgtcagcattgagtgttggggttgggttgggtgtgggacttggattgagcacaggacaagctgttcaaaaatgggttggagggagttgtgagtctgatgagatttctggggatcaaattgtgttggagctcaacaacagagtcattgatgggaagaacagcgaagtcacatttgataaatttccttattacttaagtgaaagaatccgatttgtgttaacaagcactggatatgtttatttaaaacaagacttttccaagcacttgaggaaccttcatccagcaagtagagctattttgctttctggacctgcagaaccttatcagcaaaatcttgcccgagctttagcacattacttcaaatcaaagttactgttgctagacattactgacttcttgttggagatgcagaggaaatatggatgtcccagaaaagaaccatgttttcaaaggtccatatctgaggtgactttggagagagtgtctggtctgtttggttccttgtcagtccttccttcaacaggcagaactagaggtacactacatcgacagagtagtgaaattgaaaattccagcaatcctccaaagcttcgcaggaatgcctctactgcatgtgatacgattagcacttcccaatatgctcctttgaagtgcacaagcggcttctgttttgatgaaaagctcttcgtgcagtcactttataaggtcttggtttctatctcagaaaccagttctgttattttatatatcaaggatgttgagaagctctttgttcgatcaacaaggctacacaatttgttccaaaagttaataaagaaactttcaggatcagtgttaatactcggttcccagatcattgattctgaagatgattgtacagaaattgatgaaaagcttagtatgttattcccttacaacattgagatcaaaccacctcaagaagacgcccatcttgcaagctggagaacgaaactgataaaggacaaggaaaaaagtctgtttcaagatagcaggaaccatattgctgaagtacttgcagcaaatgatgttgattgtgatgacttggaaaaagtaaaccatgctgatactatgctactcagtaattgcattgaagagattgtagcgtctgcaatttctcaccacctgatggagactaaacatccagaataccgaaatagaaaattagttatatcacacaagagtttgtcccatgtattgaatattttccaggaaagtgaaagtaatctggagaataaagattcaaacaaggaggatgctcttgcaacaaagaaagatggcgacaatgagtttgagaagcgcatgagagcagaggttgtgcctgcaaatgagataggggttacatttgaagatattggtgcattggatgatattaaagaattacttgaagatgtggtcatgcttcccctcagaagaccagacttattcaaaggtgggcttctgaagccttataaaggaatattgctttttgggcctcctggtacaggaaaaacaatgcttgcaaaggcaattgcaaatgaagctggagcaagcttcatcaatgtctcaatctctaacatcacttcaaaatggtttggggaagatgaaaaaaatgtccgtgctctgttttcactagcagcaaaggttgctccaactattatttttattgatgaggttgatagcatgcttggaaagcggactaaatatggagagcatgaggcaatgagaaagattaaaaatgaattcatggcccactgggatggaatattgacaaaacctggtgagcgaattctggttcttgctgcaaccaacaggccatttgaccttgatgaagcaattataagacggtttgagcgcaggatcatggttggtcttccatctgctgagaacagggaaatgatcttgaaaactctcctagctaaggaaaaatatgaacatatagactttaatgagctttcaaccattacagaaggatatactggaagtgatcttaagaatttgtgcactgctgctgcttatcgacctgttagagaggtacttcaacaggagaggttgaaggaaaaggaaaagaagaaaactgaggcagaagttcaaagctcagaaaatgcttctgatgcaaaaggtgataaagatcaccaagtgattactttgaggcctttaaacatggaagacatgagactggcaaagagtcaggtggctgcaagttttgctgcagaaggatcaataatgagtgagctgaaggagtggaatgaattgtttggagaaggaggttcaaggaagaagcagcagcttacttatttcctttag

SEQ ID NO: 4283 - DNA, 150 bp, Glycine Max
atggaacccacctcaggcaagcccagttctctccataaccttctaatacggtttctcctcttcggagttttggtcattgaagtttgttttgcttacctcatcaccatcgccaacgagtcctacacaatcggcgacttctgttttttctct

SEQ ID NO: 4284 - DNA, 1632 bp, Glycine Max
atggaagacccctcagattccccaccaccaccaccaccaccaccaccacaaacacccctaaaaacctacaaactaagcgccacctcaatctcctacaccaaatccaccaccaaaccctcatttacttctctcttcttcaccccatgcaccaccaccccaccaacctacatcctcaaagacatctccctcaccgccctcccctcccaaatcctggccgtgctcctaaaacccaaaacctcaaacctcgccgccatcgtctcctccctcctctccgaactccgactcacgcacctatccaacacgcgcctcgcgcgtggcctctccggcggagaacgcagaagggtctccattggcctctgtctcctccacgatcccgctgtattactcctcgacgaacctacttcggggctcgacagtacttcggccttcaaagtcatgcgaattctaaagcaaacgtgcgtctctcgcaacagaaccattattctctccatccaccaacccagcttcaagattctcgcttgcattgataggatcttgttgctctcaaaaggacaagttgttcatcatggaagtgttgccacgttgcaagcgttcttgcactccaatggcttcactgtccctcatcaactcaacgcgttggaatatgctatggagattttgagccagttgaatgaggctaagcctgttactccaccgagtattcctgaatcgcctgagagatcaagttcagtgatttcggtttctgatggtggagttaggagtagtagagagatcataaggtataaaagctctagggttcatgaaattttcactctctatagcaggttttggaagattatctacagaactagacaacttcttttgaccaacaccgcagaagcacttctcgtgggtcttgtgttgggaactatttatatcaatatagggtttgataaggaagggattgagaaaaggtttggtctttttgccttcactctcacgtttctattgtcctccacaacggaaacccttcctattttcatcaacgagagaccgatcttgctgagagaaacttcgagtggggtttataggctctcgtcttatctcattgcaaacacgcttgttttcttgccctacttgttcgttgttgctgttatatactctatccccgtttattttttagtgggtctctgtgcttcgtggctttcttttgcttactttgttttggtcatttgggtcattgttctgatggcaaactcgttcgttctcttcttgagctctcttgctccgaactacattgctggaacttcgcttctaacggtgcttctcgcagcgttttttctcttctctgggtattttatctccaaggaaagcttgccaaagtactggctcttcatgcattttttctctatgtataaatacgctcttgatgctcttctcatcaacgagtactcgtgcttggtgacaaagtgtttgatatggtaccaagagaatgaacagtgcatggtgactggtggtgacgtgttgcagaaaaaaggactcaaagagagtgaaaggtggaccaacgtgtacttcttgctcgggttctttgtgctgtatcgtgtgctttgcttcttggttttggttagaagggtttcgagatccaaaacttaa

SEQ ID NO: 4285 - DNA, 774 bp, Glycine Max
atggaagctgtgatgggactgatgcggaggattccgccgaaacacacagaaacagctctgtctgcgcttctgagccttatgcctcaccactcctccgatctcctctctcaagtcgatcagcccctccaggttctgtgcgatgtcgaatgcggcaaggagttcattttgtgtgaatacaacagagacgccgactcttacagatcaccttggtcaaataaatatcatccaccattagaagatgggtccctcccttcttcagagttgcggaagcttgaaatcgaagcaaatgacatatttgcaatatatcgtgaccagtattatgaaggtggcatttcatcagtttacatgtgggaagatgataatgaaggtttcgtagcctgctttttaataaagaaagatggctcaaagacagggcagggtcgacggggatatttagaggaaggtgcatgggatgctatacatgttatagaggtgggaccagaggaagaagaaaacaccaattatcggttaaccagtacagttatgctgactctgactacaaataatgagtcatcaggaactttcagtttatctggatcaattagacgtcagatgagtatgaagctatcagttgctgatggtcatctttgtaacatgggaaggatgattgaagaaatggagagtaagctgaggaactcactagatcaggtatactttggcaaaacaagagaaatggtttgcacactgagaccaccatctgaagtggcacagatgagaatgcctgatagcgcctga

SEQ ID NO: 4286 - DNA, 1335 bp, Glycine Max
atggaagggaatttgccacagggaggtataattcaaggtgggacttcttttggtggctttgatttgccgggatcaattcgggttcagcatcaagcacaacatccccattccatgcatcaacatcaaactcatccgcgacaagggtcttctgtacattccgccgttcatgatggttttccacttacaatgggaaccatgcagaactgtgaccaaaccatttcattggctgactttagtaaaggagacagaagtaaaaactcggcgagtgaggaagacgagccgagctataccgaggatggtgttgattgtcaccatgaaacaactagagggaagaaaggatcaccttggcagcgtgtgaagtggactgataagatggtaaagcttctgataacagctgtttcttatataggtgaggatgtaactgctgatggtggtagcagcggaagaagaaagtttgcggtcttacagaagaagggtaagtggaaatctgtttccaaggtcatggctgaaaggggttatcatgtttcacctcagcaatgtgaggataaatttaatgaccttaataaaaggtataaaaagcttaatgatatgctagggaggggcacttcttgtcaggttgttgaaaatcctgtgctgttggatgtaatagattttctttctgagaaagaaaaggacgacgttcggaaaatattgagttcaaaacacttgttctatgaagagatgtgttcttatcataatggcaacaggttgcatttaccccatgatcctgcattgcaacgttcactgcagttagctctccgaaatagagatgatcatgatgatgatatgagaaggtcccatcatgatgaagatgatcaagatgtggaaattgatgatcatgatgactttgaagagaattgtgcttctcatggtgatagtagaggaatatatgggccattaggtggatctatgaagaaattgaaacaatgccaaggccaagaagatgctaatacttttggtaactctttaaattgtcaggactacaacaaaagttcatatccccatggacagatgatcccatctgatgtgaatcaaggtttacctgaaggcatgaaagcagcttggttacagaagcaatgggttgaatctcgcacacttcagttagaagaacaaaagctacaaattcaggtcgagatgctggaactagagaaacagagattcaagtggcagaggtttagtaagaaaaaggatcgggagttggagaagctgagtctagaaaatgaaagaatgaagcttgaaaatgaacggatttctttagaactgaagcgaaaggaaatgggcactggctttaaatag

SEQ ID NO: 4287 - DNA, 267 bp, Glycine Max
atggaagggtcttcaccatccattgaagaagagagaacagccactttctatgtgtaccatccttgctattttcttcaacaagcactcagggctctcttgaagtgtgtagatgatcctattacaaactctccaacccacaaaagctccccagatgctgcagatccaccttccacaactaatcaaaccattatcattgcaagtttaatggcaacgcgtggcagtcgagggtctaaaattagcgatgggtcaggccctcagcataattaa

SEQ ID NO: 4288 - DNA, 348 bp, Glycine Max
atggaagggtcttcaccatccattgaagaagagagaacagccactttctatgtgtaccatccttgctattttcttcaacaagcactcagggctctcttgaagtgtgtaggtattgatgagtctgaaaacacaatgtgttcacaggccaataaacaagagaaaagctcactgccacaaactccttctgcagatgatcctattacaaactctccaacccacaaaagctccccagatgctgcagatccaccttccacaactaatcaaaccattatcattgcaagtttaatggcaacgcgtggcagtcgagggtctaaaattagcgatgggtcaggccctcagcataattaa

SEQ ID NO: 4289 - DNA, 348 bp, Glycine Max; identical to SEQ ID NO: 4288

SEQ ID NO: 4290 - DNA, 1002 bp, Glycine Max
atggacaagaaggaactcgttgccaggaacaaagacaggagagctaaggtcgagagagagatattacaaatggtggatcatccttttttgcctactctttatgcctctctcgattcgcctcgctggtcttacctcctcaccgagttctgccccggcggcgacctccacgtcctccgccagcgccagcccgataaacgcttccaccacgccgccgttaggttctacgcatctgaagtagtggttgcgttggagtacctacacatgatggggataatataccgtgatttgaagcctgaaaacgtgctcataagatcagacggtcacataatgctcacagactttgacctatcattaaaaggtaacgataccacatcaacggctcagatcgtgtttgatgaagatcgacccagcaacaccggtagtaacgaacattcgaagaacatgtcatcatgcatgttgccgaattgcatggtcccatcggtcccatgcttccatccaaagcaaggtggtagcaagaggtcctctcgcagtgggtcccttgagatcatagcagagccaatagaagttcgatcaacgtcgttcgttgggacccacgagtacttggcgccagaagtgatttcgggggaaggtcatgggaacggcgttgattggtggacattgggtgtgttcatttttgaaatgttctatgggatgacacccttcaagggacttgagcatgagctaaccctagccaacatagtggctcgagcccttgagtttcctaaggagccgatgatccctggagcagccagggatttgatctcacaacttttggtgaaggactcaagaatgagactagggtctagaatgggtgccgtggcaattaagcaccatccatttttcaacggggtcaattggccattgttgaggtgtgctacccctccctacatcccttcatcagacaagtgcaaggagttgcttcctctctataattgcacaaacaacgctctagacttctattag

SEQ ID NO: 4291 - DNA, 3615 bp, Glycine Max
atggacactgaaggcttatcggtaatctgcgctggcattggaaccatcgaagccgacgatgaaggcaaccaaattggttacatcaaaggccaatactgtctcgataatctgaaagacttgctacgttttctgaggcgcgacgatccccaaacgcgcgatgtcttcaagcaagtctgcaaatggaacatcgtttccaagtacttaatccctaccatcgagctctatcacgaagatcgcaacttgctactcaatgcagtgaaggttctggtgttccttacaatgccgatcgagccttcttccacggatatatctcagcagttggagtatctttggggtttgaagtctgctttgactaacagtgatgttgctgcagtgatagtgtcgtttctagagagaccgctcgagaatttggaacgtaatgcgttcagtgaggatgattggaaattggtacagctagtgctgacgttatttagaaatatcctagctgtccaagagattccgatgcaccagaagtcagggggacttgctactcagttgttatcgctgagagaccggtttctggaacttttgtttcgtgaaaatgtaatggatataatcctggttatatctcaatacgttggtagttccaatgtttatctccgtcaggataacttgcttctactggaaatttttcattacattttgatgggtcaggacccggagttaattgtttgggcacatttgaaggaatcaaaggcggatgaacaaccccaaacttctctttatagtctccagttcattttggaggaggaaaagaagagaagaaatatttgtaagctcaacaatctgagtcgacattcacaatttagtccaacatttgctcggcttaccatggatggttgtaaggcagtaattaagggaaaccctaattcttctcataatgtgctgcttaaagcacaaaatgtcgctcgaggtcctaccaaaagaactgtgtgggatcatccaagaataatttttttgatgcaatccattcgtgaagatattgaaaaagaacatccctcaattcaaaaaagtgatgttgctgttttctttcaagtggctgaatttgtcacttcatttcagttttacaagtattcagcttctaagaccaaggaggaaggggacacatttgagactttgagtgataaagatgcagtcacctcagatttcagtggtcaaatatgtgggccaattgcagcatccttgaatgagacaatgtttcaattgatcatttcaaagtggcggcatgcctatgatggtctaaaggaaacaaatgactatcagtttctatctgcagctggttctcttttgaaaaacatgattcgcatgctggatttgatacttaaattgttgcctgaaaactcaaaggaacctcaaacagctcgcatacttctgtacaagttattttatgatcagaccgaggaagggatgactcagttcctattgaatttgattaaaacctttgacatccacaagcaacccaaaagtaatctttcagatttagtggaaatcattcacaaggttgtaaggctgatggataatcttcagtctcgaggagcattgagggtgtctagaaaatcaaggaaagtgaaaaaaaataaaattccagaaggaacagaatcaggggacaaactgtctggagatcattcttgcattcaaaatgaaactggcatctcaactgccaatcaatcagctgaaaatcagccactgctggaagtactaccaaatgcaaattccactggggaagatgttgtccctgatgataatgaacatgaaaatcgtgttgaggaagatgagaactcccaagttgggttagaaccaatgggagccacaaattctgaacatgttaatgaggatatgttggatggtactaataatttttcggaagatgagcaactacatgcatataatgaagttgatttcaaggtttcaacgctggtctctgcctttgcaaatcacaatatcattcagaaattatgttggttgctcaagttttacaagagcaattccctggctacaaattattacataataagcatgctgcggagaataagtgatgaccttgaactccatcctatgctttaccagttatcactgctcacaactttttatgacatcctgattgaacaaaagtcatgcccctgcaaggattatgcaggtatagttgatttcctgacttgtttggtcagaaagatgctaaagaaaatgaaaaagcaacctctcttgtttgtggaactccttttctggaagactcgaagggaatgtcattacatcaatgctgaatatttgttgagcgagcttggtcatttgaagaaagaaagtgccaattggaataactctcaaggagatgaagaaattggttcatccccaacaaaggtgtggacacgtagaagcatagctgatgcacttggtgaggatgaagctgatgttgtgattactcatgactcaagatgtcaacatggggagcaattgatggaagatgaatctcaactggctccaaggagaaggaagaaacttgttcttgatggtgatttggaaagacaaatcaaggatctctatgagaaattcaaagatgaaccacattgcagtcgtcatatagctgaagtgctagatccagatggtaaaatttcaccagctcaaatttccaatatgttaaaaagattaggactagcagttgcacctaagagaaagatgggtgatgctgatgctgaaggacatttgtctactagccctaatcagttagatgtttgtgttcaatttcatatttataggcaaaaaaagaagagagtccaggctttcaatgaagctcaagaagctctgatcaaagttctatatgagcaattcaaggatcacagaagatgcagttacatgatagccaatgcactggatgaggatggtaaaatcactgctgctcaagtctctcgaaaacttaagcaacttggtttatctcttcctcagaagagttctggaggcaaaatgcacccaaaggatgcagatctcatggatctttcaaatgataggattaatgaatctgatgatgagacattggtaacattgataaaaaggaagaaaatggagaatgacaaattatcaaggggacagttacatggacaaatcagtgaggatagattgtcaatagatgattctgatgatgaaatgctcagctctgttctcaacaaagtatcaactgaacaattacttgaacccatcaatgtggatgcattgtcaagagatgattctgatgatgaaatgcccagctctgctctcaacactgttcacaccagatttaattttctttgtaatggtacaatttatggatgtagaagaactagaagatcctctcttaattcaaagcaagttgagcttgaaaatatccaaattcaggagagaataatgggcgatgattctttcaatgaaggcaaaacagatgctttggaaaggtatgcctttgtaatcactatcatttttatttttgaacatcagcaaatggatgacttagcagattcagaagatgaagtggctgttagtggatttcctgacaatgccagatctagaaggcagctgagaatggtgattgatcctgaggatgatgactga

SEQ ID NO: 4292 - DNA, 528 bp, Glycine Max
atggacgccacgaaggtagtgacgctgaaagcaatcgaagcaactccgtcaaccttcaaagactacggtcaggtcatcgaggcttcgccggacggccaggaatttggttcccacgatgctcaactcgacctttctcaaggaactccaaggttctacattatgcatattgaaaatcgcccgcttaagttttctagtattacacatcatgcaagcgtgactcagtgcctcgggtctattggtggccatgtttggtatcttggagtggccaagtcatccattgttgattcaaatgaaatcaaggatggcacaagcaagaagattgtgcagtcaccttccggtcattcatatgtgcctccagccattgaggatgtccaagttttcaaggttgcaggttccaaatttcttaagcttaaccggggaacatggcatgctggccctctatttaaggcagctgcaatcgacttttacaatctagaactgagcaacacaaatgtaagtttttcacattcccctttccttggtcattag

SEQ ID NO: 4293 - DNA, 558 bp, Glycine Max
atggacgccacgaaggtagtgacgctgaaagcaatcgaagcaactccgtcaaccttcaaagactacggtcaggtcatcgaggcttcgccggacggccaggaatttggttcccacgatgctcaactcgacctttctcaaggaactccaaggttctacattatgcatattgaaaatcgcccgcttaagttttctagtattacacatcatgcaagcgtgactcagtgcctcgggtctattggtggccatgtttggtatcttggagtggccaagtcatccattgttgattcaaatgaaatcaaggatggcacaagcaagaagattgtgcagtcaccttccggtcattcatatgtgcctccagccattgaggatgtccaagttttcaaggttgcaggttccaaatttcttaagcttaaccggggaacatggcatgctggccctctatttaaggcagctgcaatcgacttttacaatctagaactgagcaacacaaatgtaattgatcataccacacacagctttgaaaatgacaatggagtggtctttttaattgatgagtaa

SEQ ID NO: 4294 - DNA, 1668 bp, Glycine Max
atggacggccatatgggaatgaggaaaatcagttctcactgctctatccctgatttggatgattccgatctcttacgtttgcttgagaaaccaaagttgaacattgagagacagagatcgtttgatgagaggtcactcagtgaactctccattggtcttgcgagagcgggcttggataactatgacacttattcgccagggggaagatctggttttaacacacctgcttcgtctacacggaactcgtttgagcctcaccccatggtcgccgatgcctgggaatccctcagaaaatctctagtctattttagaggccaaccggttggcacaattgcagctgttgatcatcaatcagaggaagttctaaactatgatcaggtttttgttcgtgattttgtgcccagtgctctagcctttttgatgaatggtgaaccagagatagtcaggaacttcttgttgaagacactgcatcttcaggggtgggaaaaaagagtagatcggtttaagcttggtgaaggtgtgatgccagctagtttcaaagtccttcatgatcccattaggaaaacagacactcttattgcagattttggtgaaagtgcaattggaagagttgctccagttgattctggattctggtggatcattttacttcgtgcgtacacgaagtccacaggggatttatctttagctgaatcaccagattgtcaaaagggaatgaaacttatactgactctatgcttgtcagagggttttgatacatttccaactttgctttgtgctgatggatgttgcatggttgatcgaagaatgggtatttatggttatccaatagagattcaagcacttttcttcatggcattgagatgtgctttgtcaatgctgaaacaggatgacgccgaagggaaggaatgtgttgagcgtattgtgaagcgtttgcatgcactaagttatcatatgcggagttacttttggctcgacttccaacaactaaatgacatttatcgatataagactgaggagtactcacatactgctgtaaataagtttaatgttattcctgattcaatcccagattgggtatttgactttatgccaatgcgcgggggctacttcattggaaatgttagtccagcccggatggattttcgatggtttgctttaggaaattgtgttgcaattctatcttctctggcaactcccgagcaatcaatggctatcatggatcttattgaatctcgctgggatgaattagttggagaaatgcccctaaaaatatcctatccggcaatagagagccatgagtggcaaattgtgactggttgtgatcccaaaaataccagatggagttaccataatggaggatcttggccagtgctcctgtggctagtaacagctgcttgtatcaaaacgggtagaccacagatcgcaagacgtgcgatcgaacttgctgagagtcgtttactgaaggatgggtggcccgaatattatgatggtaaacttgggagatatattggcaaacaggcaagaaaataccaaacatggtctattgcaggttatctggttgcaaagatgatgctggaggacccctcacacttggggatgatttcccttgaagaggacaaacagatgaaaccggttattaaaagatcatcttcttggacttgctaa

SEQ ID NO: 4295 - DNA, 1668 bp, Glycine Max; identical to SEQ ID NO: 4294

SEQ ID NO: 4296 - DNA, 1032 bp, Glycine Max
atggacttctttactagagacataaatgaggactctatgcttagatgtccattcttgaggaacatcaatgagcctactaacttctcattcttttcacctttggctttaccaatgcctgttcgtggagctaaaggtccaatttttgaagatggtcccaattttgatttggcatttaggcttttccacgggagtgatggtgtagtacccttatctgacagatcttttcggccttctgagaagaaagtacaggcagaacctcccaaatcccaattcaatcctttagctgcaaaggcagcaactattagtctgtcatcatttggatttggcggggctttcggttttgatgcattttctgagaagtggaacaaccagaaaagaaaatccaaatcatcaaaaaatgaaccttcttcacaggatggttcaaagcatgaggccaacaatgattggcttcaaaatggtaactgccccattgcaaagtcataccgagcagttagtaatgtccttccacttgttgcaaaggtcattcagcctcctccaggcataaaatacaagtgcccacaagcagtagttgcagcgcgggcagctattgcacgcactgcatttgcaaagaacctccgtcctcagtccctgcctacgaaggtcctcgtgattgggatgctgggcatggcggctaacgttcccttgggtatatggcgggaacatactaagaaattttcgccgacatggtttgctgcagtccatgcagctgttccattcatagcaatgctaaggaagtctgtcttgatgcctaaatcagcaatggcatttactatcgcggcatcggtgttggggcaagtaattggttcgagagctgagaggtacaggctgaaggcagttgctgcaaaaaaggtgtctataactgaaacctctggtgttggtcctctcctgttaccagtggctactacaaaagacaagcactgtggtgatgctgtggattggaaagcagtttctcttcagctggcagcaacttcaccaactgatgtattttgttga

SEQ ID NO: 4297 - DNA, 1032 bp, Glycine Max; identical to SEQ ID NO: 4296

SEQ ID NO: 4298 - DNA, 1032 bp, Glycine Max; identical to SEQ ID NO: 4296

SEQ ID NO: 4299 - DNA, 1032 bp, Glycine Max; identical to SEQ ID NO: 4296

SEQ ID NO: 4300 - DNA, 261 bp, Glycine Max
atggagaaaagcaagtcattccctgaatactcctgctcctacactgaatttggcttcagtgaaaggtccaactcatataattttaatggtccaaaccagaagggaaatgggttttctgcatcaagtgatccagaaatcaagagaaagaagaggatcaaggcctacaatgtattgacagtggagggaaaacttaaaacaaatgtcagaaacagcttcaagtggatcaagaacaagttcagcgacattcgctacggtgtgtga

SEQ ID NO: 4301 - DNA, 1842 bp, Glycine Max
atggagaagaagatgcagcacgcggaggagctagtgagggagttcctggtgttccgtggcttcaccaacaccctcgaatcctacgatgccgaattgcgcaccgacatcggaaagggattcgaagtcgacaagatcctcgacctaatcttctccctctacgtccccaagttccacgccgatagcctcctcgcgctcctcggtttcttcaagcactacctctcttcctcctccgactcgccgctcctctccacgctctctaagttggagacttctcttctgcgcttctacgtcgtccacgccgtccagtgcaaccgcaatgacaaagtcgtcgacttcttcgcgctctacggtgccgaattgctgcagagctcgcaagattggactcactggttcgcgattccttataagaaaaacccgcacttggatcccgagtttcgagtttttttctccaaggagtggtatcaggctttgcatctttcttctagaaacttcttcagcgaggtcagttcagagatgaatgctactaacctactcaaacgagatatcgtacatttaaatcttaagttgtcacaacttcaagctttgcttgatgagaaagaggcacagttacgccaatttagaagtatggaaggggggagtactggttcatcgagcaatttgcgtgaagaaactgctcgtgtgtcgaaagattcttcagagctttttccaactggcattccacaagtaggtcaaacagagattagccaagattcagttgcgggtggactggggaatattcgttcggagttgattggctccacatctggcaatgattctactacttttctatcgaatgaccgtatgagaaatggcagagctgacaatgccactctaaaagacaacaatggggaagtttttggggaagaagattttgctgaggtgaaagtagagtaccaggagacatttttggggcacaccggtccaatcagtcggtgttgcttctctgcatctggaaacaatattgccagtgcttctctggatggaactgtcaggatatggacatatgatacatcaactccagtgtctagaaatgcaaccatatattgtggcactgaaattttgtcacttgactgggaatgtaaatcagaccgcttgcttcttataggtacatccgatgggtgcattaaggcatggaatgtggatgcaaagagagttgtctgtgacctcaacacaaccgaagcatttccaagtgtattggacataaagtgcagtcctgtggaacctatttttgtgtctgcagcagcatctggaggggctggttctaactatattgacaacctgggttttgcttcacttactgtgtggaacatgaagacatggaaagccatgacagtccttcctcttggagaagatccaccagcaattacttctctatgctttaatcacaatggaaagattttggcagcttctgccgttgatggaatgattcacatgtttgtcgaagacatgtctgctggtctacaaatcactggctggccagcacatgattcttccatcagttctattctgtttggaccagatgagactagcatttttagcctgggctctgatgggaaggcaagtcaaatcctgtggtcgagagactctagtagacatgagatggcattagatgcaaatgggaggagactcttggtaacatccagttcatttagagcacccatataccaggttcatggtcatttgagtggatggagaacacttccgcacggtgctcctattactgctgtggattggcatccgaccctgcccattttcttgactggatcagctgataactctgtccgagtaacatctttatcatag

SEQ ID NO: 4302 - DNA, 1875 bp, Glycine Max
atggagagaaagttcatggccttaggtttcatttggtgggtggtggtggttcatccactatgcctgatttcagctaacatggaaggagatgctttgcatagtctgaggacaaacttacaggatcccaacaatgttttgcaaagttgggatcctacacttgtcaatccctgtacatggtttcatgtgacatgcaacaatgataatagtgtcataagagttgatctggggaatgctgcgctgtctggtcaacttgttccgcagcttggtcagcttaagaatttgcagtatttggaactttacagcaataacattactggccctattccaagtgacctggggaatcttactaacttggtgagcttggatctgtacctgaaccatttcactggcccaatcccagattcgttgggcaagttgtcaaaattgcgtttccttcggcttaacaacaacagcttgtcgggtcctattcccatgtcactgaccaatattacagctctccaagttctggatttgtctaataatcatctatcgggagtggttcccgataatggctccttctcattattcactcctatcagttttgcaaacaacatggatctatgtggacctgtcactgggcacccttgtccaggctctcctccattttctcctcctcccccttttgtccctccacctccaatttctgccccagggggtaatggtgccactggagcaatagccggaggtgttgccgctggtgctgctctattatttgctgcacctgcaattgcatttgcctggtggcgtcgaaggaaaccacaagaatttttctttgatgtgcctgctgaagaggaccctgaagtccatctgggacagcttaagaggttctcactgcgagaactgcaagttgcaacggatagtttcagcaataagaacattcttgggaggggaggatttggtaaggtgtacaaaggacgcttggcagatggttcactggtggctgtgaaaagattgaaagaggaacgcactcctggtggggagcttcagtttcagactgaagtggagatgattagcatggctgtgcatagaaatctcctccgactacgcgggttctgtatgacaccaacagaaaggctacttgtttatccctacatggctaatggaagtgttgcttcttgcttaagagagcgtcctccatatcaagaacccctggattggccaacccggaaaagagtagctttgggatctgcaaggggtctttcatatttgcatgatcattgtgacccaaagattattcatcgtgatgtgaaggctgcgaacatattgctggatgaagagtttgaggctgttgttggggactttggattggccaaacttatggattacaaggacacgcatgtgacaactgctgtacggggcactatcgggcatatagctcctgagtacctttccactggtaaatcttcagagaaaactgacgtttttggttatggtatcatgcttctggagctgatcactggacagagagcttttgaccttgctcgactcgctaatgacgatgatgttatgctgcttgattgggtaaaaggacttctgaaagagaaaaagcttgaaatgttggtagatcctgatctacaaaccaactatatagaaactgaggtagaacagttaatccaggttgcactactctgcacacaaggttccccgatggaccgacctaagatgtcagaagtggtgagaatgcttgaaggtgatggcttggcagaaagatgggatgagtggcaaaaggtggaagttctccggcaggaggtggagctggcccctcatcctaattccgattggattgtcgactcaaccgaaaatctgcatgcagtagagttatctggtccaaggtga

SEQ ID NO: 4303 - DNA, 174 bp, Glycine Max
atggagatggaagagacattcaactcatgctttctccatgttttcttagctactataactccaatagtaaaccatgaggaccttcgagttgctgctgtctggggatgcacatcaacctccatgatcacatcaagtgcacacatgaaacaacatcataatatcataagtttctag

SEQ ID NO: 4304 - DNA, 1500 bp, Glycine Max
atggagcattgtaactgctacatgttcacgctgagccttcttcttcttcttcttcttactccgccttctctctccgacgatctcggattcgattttccggcgaagaagctgataagagaccttaacctttttccttctgaagatgtcaacatcgttcctcgccactccaattctcacgccaacaaaatcgtcgagaaaccgcttaggttcccaaacttagtgccttcagactccggcatttccctcgacgacttggctcaccgcgctggctattatcttattcctcattctcatgctgccaagatgttctactttttctttgaatcaaggaacagcaagaaggatcctgttgtgatttggttgactgggggaccaggttgcagcagtgaattggctgtgttttatgagaatggccctttcaagattgctaacaacatgtccctagtgtggaatgaatatggctgggacaaggtttctaaccttctgtatgttgaccaaccaactggaactggctttagttacagtactgataagcgtgacattcgtcatgatgaagaaggtgtgagcaatgacctctatgactttctacaggccttctttgctgaacatcctgagtatgtaaagaatgacttttttattacgggtgaatcatatgctggacattatattccagcttttgcagctcgtgtccataggggaaacaaagctaaagaaggaattcatataaacctaaagggatttgccattggtaatgggcttactgatcctgggatccagtataaagcttatacagattatgcactggacatgggcataattcagaaggctgactatgaacgcatcaacaaagtgatggttccagcctgcgaaatggcaataaaactatgtggcactgatggaaaaatcgcatgcacggcatcatattttgtttgtaatacaatattcaattccatcatgtcacatgctggtgatatcaattattatgacatcagaaagaagtgtgaggggagcctttgctatgatttttcgaacttggagaaatacttgaaccaaaaatctgttcgggacgcactaggggttggagatattgattttgtgtcttgtagttctacagtttatcaggctatgctggtggattggatgaggaatcttgaagttggtattcctgcccttcttgaggatggaatcaatatgcttgtgtatgctggggaatttgatctcatctgcaactggcttggtaattcaaaatgggttcatgccatggagtggtctggccagcaagaatttgtggtctcatccgaagttcctttcacagttgatgattctgaagctggattattgaagaagtatggacctttaagtttccttaaggtccatgatgcgggtcacatggttccgatggatcagccgaaggcttcgttagaaatgctgaagaggtggactcagggaaccctttcagaatctgcagctgatgcggagaaattggttgcggagttgtaa

SEQ ID NO: 4305 - DNA, 1566 bp, Glycine Max
atggagcctctctcttccaccaaacacaacaacaatctctccaagccttcctccctccacacggaggctccgccgccggaggccagtcccctccggaagatcatggtggtggcctccatcgccgccggggtgcaattcgggtgggccctacagctctctctacttaccccttacgtccaactgctggggattccccacacttgggccgccttcatctggctctgcggcccaatctccggcatgctcgtccagcccatcgtgggataccacagcgaccgctgcacctcccgcttcggccgccgccgccccttcatcgccgccggctccctcgccgtcgccatcgccgtcttccttatcggctacgccgccgacctcggccacatgttcggcgactccctagccaaaaaaacccgcccccgcgccatcgccatcttcgttgtcggcttctggatcctcgacgtcgcaaacaacatgctacaaggcccctgccgcgccctcctggccgacctctgcgccggagaccaccggaaaacgcgaaacgccaacgccttcttctccttcttcatggccgtcggaaacgtcctgggctacgccgcgggctcttacagcggcctccacaacgtcttccctttcactaaaacaaaagcatgtgatgtttactgcgcgaatttgaagagttgtttcttcctctccatcgcgcttcttctcactctctccacaatcgccttgacctacgtgaaggagaaaacggtgtcgtcagagaaaacggtgaggagttcggtggaggaggatgggtcccacgggggcatgccgtgcttcgggcagttattcggtgcgttccgcgaactgaagcgtcccatgtggatccttctgttggtgacgtgtctgaactggatcgcctggttcccttttttgctattcgacaccgactggatggggcgtgaggtgtacggagggacagtaggggaagggaaggcgtacgataggggtgtccgtgcgggtgcgttggggctgatgttgaactctgttgtgcttggtgcgacgtcgttgggagtggaagtgctggcgcgtggggttgggggcgtcaagaggctgtgggggattgttaacttcttgctcgcggtttgtttggccatgacggttttggttactaagatggcccaacattctcgacaatacaccctactccccaacgcccaccaggaacccctgcctcctcccgccgccgtcaaagccggcgcgttggctctcttctctctcctcggaatcccactcgcgattacttacagcataccctttgctctagcatcaatattctccagcacctcaggggcaggccaaggtttgtctctgggagtgctcaatcttgcaattgtcataccacagatggtggtgtctgtgataagtggaccatgggatgctctatttggaggtggtaacttgccagcgttcgtggtgggtgcggtggcggcggccgccagtggcattttatccataatcctgctgccatctccaccaccggatttggccaaagcagcaacggcagccggaggaggattccactaa

SEQ ID NO: 4306 - DNA, 1350 bp, Glycine Max
atggagcttggagacactaccacagtgatggaaacgtcgtccggtgaggctgtggcggcgcatggcggtggcgaggtgattatgatggatgcgaattccgggtggtggagaagaagaagaagatggccccgccaagaaactttggctctcttgaagataaggtccgatatggatgttgtgtttcgagattcaagtcttaagggtccactttgggaagaagttgcaaggaaactatcagaactgggttaccaccgaagcgctaagaagtgcaaggagaaattcgagaatgtgtacaagtaccacaaaagaaccaaagagggcagaagtgggaaacacgagggaaaaacctacaaattttttgatcaattacaagctcttgagaatcaattcacagtctcttcttactcgccaaaaccacaacccactttggcaacagcaacaacaacaacaaacacaataacattaccacccccaaccaggccaagtgccataacaccaatctcttatgtcaccaccactgttccgtccacaaaccctacaatcatatctccttcaccaccacaaccaccaaccaatgccaccacgacaaccacaatcacttctccaacagtagtaaccaaccctagaaaccctccacaacccaacaacaacaacaacagcaataacatcccttactctttgcccaacatgaacaacctcttctcaacaacttcaacttcttcttccacggcctcggatgaggacttggaagagaagtaccgtaagaagagaaagtggccaaagacagaagttcatgctttgataagactgaggacaagtcttgaaaccaagtaccaagaaaatggaccaaaggctccattgtgggaggatatatcagcaggaatgctgaggctcgggtacaacaggagtgccaagagatgcaaagagaaatgggagaacatcaacaagtacttcaagaaggtcaaggagagcaacaagcaaaggcgcgaggatagtaagacatgtccctattttaatgaacttgaagctttatacaaagaaaagagcaagactcagaacccctttggcgcttcgttccacaacatgaagccacatgagatgatggagccattgatggtgcaacccgagcagcaatggagacctccctctcagtacgaacaaggtgcagcgaaggagaacaataataatgaaagaaaagaaagagaggaggaggaagaagatgaagaagaagaagaagaagaagaagaggatgaaaatgaagagggagatctagagagtgtggaagatgaaggaggtaaccgttatgagattgcgacaaataaactttcttcagtggacaccgttgaatga

SEQ ID NO: 4307 - DNA, 1143 bp, Glycine Max
atggaggcaaagcgaggccatgccctcatgtgcttggcacgtgtttcactcttcctctgcgctctaaccctatccgctgctcacggaagcaccacggttcaagacatcgcgagaaagttgaaactcggggacaacgagcttctgcgcacggagaagaagttcaaggttttcatggagaattacgggaggagctactccacagaggaggagtatttgcgccgtttggggattttcgcccagaacatggtcagagcggcggagcatcaggcgctggaccccaccgccgtccacggcgtcacgcagttctccgatctcaccgaggacgagtttgagaagctctacactggcgtcaatggcggcttcccgtcatcgaataatgccgccggcggtattgcgccgccgttggaggtggacgggctgccggagaattttgattggagagagaaaggagctgtcaccgaagttaagttacagggtagatgtggatcatgctgggctttcagcaccacaggatctatagaaggagccaattttcttgccaccggaaagctcgtcagtcttagtgaacaacagctccttgactgtgacaacaagtgtgacataacagaaaagacttcatgtgacaatgggtgtaatggaggtcttatgacaaatgcctacaattatttgctcgagtctggtgggttggaggaggagtcttcatatccctacactggggagagaggtgaatgcaagtttgatccagagaaaatagcagttaagatcacaaatttcaccaatatccctgctgatgagaaccaaattgccgcatatttagtaaaaaatggtccacttgctatgggcgtgaatgcaattttcatgcaaacatacattggtggtgtctcatgccctctcatatgtagcaagaaaaggctgaaccatggtgtgttacttgtgggatatggtgcaaaaggcttctcaattcttaggcttggcaacaaaccatactggatcatcaagaattcgtggggggagaaatggggagaagatggctattacaagctctgcagagggcatggcatgtgtggaataaacactatggtttctgctgcaatggtgcctcaaccacaaacaacacctacaaagaattatgcttcttattag

SEQ ID NO: 4308 - DNA, 564 bp, Glycine Max
atggaggcaccgaagctgaaggtagtgacactgaaagccatcgaagcaactccgtcaaccttcaaagagttcggtcaggtcgtggaggcttcgcgagacggccaggaattcggtccccacgatgctcaactcgacctttcccaaggaactccaaggttctacattatcaagcttgaaaaatgcccgcttaagttttctagtattacacatcatgcaatcgtgactcagtgcctcgggtctatcggtggtcatgtttggtatcttggagtggccaagtcatctgttgttgattcaaatgagatcaaggatgacacaggcaagaagattgtgcagtcacgttctggtcattcatatgtgcctccagccattgaggatgtccaagttttcaagatttcaggttccaaatttcttaagcttaaccggggaacatggcacgccggccctctatttaaggctgctgcaatggacttttacaatctagaactgagcaacacaaatgagactgatcataccacacactactttaagaaggacgatggagtgatgtttgtaattgacgattaa

SEQ ID NO: 4309 - DNA, 576 bp, Glycine Max
atggaggcaccgaagctgaaggtagtgacactgaaagccatcgaagcaactccgtcaaccttcaaagagttcggtcaggtcgtggaggcttcgcgagacggccaggaattcggtccccacgatgctcaactcgacctttcccaaggaactccaaggttctacattatcaagcttgaaaaatgcccgcttaagttttctagtattacacatcatgcaatcgtgactcagtgcctcgggtctatcggtggtcatgtttggtatcttggagtggccaagtcatctgttgttgattcaaatgagatcaaggatgacacaggcaagaagattgtgcagtcacgttctggtcattcatatgtgcctccagccattgaggatgtccaagttttcaagatttcaggttccaaatttcttaagcttaaccggggaacatggcacgccggccctctatttaaggctgctgcaatggacttttacaatctagaactgagcaacacaaatgtaagtttttcacattcccctttccttggccattggcgagttgcatgcatcttagttcatttgcaatgctctctatag

SEQ ID NO: 4310 - DNA, 1386 bp, Glycine Max
atggagggctctgcagaggatctcggagcccccgagtcatgggaggtcgctgatttggacgagtccatgaaccgcttgaacctcatggtcttttccaacaacgattctaagcaacctcaccagcgtctcgccgattataatgacgatgatgctccgctgccgccgcctccttcgtccagttgcgacgaggtttccgatgacgccatcaatcaggttgatcagttccttcgcgaagccattcagaaccctcgcgaacggctttcaatcttgaggatggagcaagatgttgagaattttattcgtgatcctactcaacagcagcttgaatttaagcagcttccaacatcctatttaaggctggccgcacaccgggtggctcagcattactcattgcagtcaatggttttactggataatagtttaccagatggttctgggtcaagaattattgttcgcaaaacctctgaatgtaagcttccagttatccgccttgcagacatcccagtaaaattatcaccagaaaacagtgctgtcatgaaggttgcaatcaaacagaggccgcagaagtggacacagattctcagcaatgcaaattcaaactcaatgaagaataatagctctaaaagtgtggaggagagaaaagaggaatataatagggctcgagctaggatttttaattcaagtaataatgatggtactgtaggtgggaagccagaatgtgagtcaaggcagcaggataactcattgcatagttccttggttgttcctcgggtggaagataaatcagcttctgtatctgatgtcacttctggtagggggctggttgagtcttcaactaataccaatagggctagaagtaggatagagaaggagccagttggtaggtacaggcaaaataatagggtggctatatttcgggaccgagaggttgaccgcaaagatcctgattatgacaggaactatgataggtatatgcaaagatttgatcctggttttgggttcaatggaggatcatatgcaatacagccaatgtatacagcagtattgaattacaagactgagtttccacagcttggatccactcacagaccccacctttctgctgaacaccaaccacggcctcttccacagcatatatctgggccctgggctgcacaatcagcacctgctggaattggatatggacatcccgagaccatgatgccaccatttaatcctaatcaagttggtgcacactcatcatcagccatgtatctgcattcatctcagtatccctgtcagcgccctggaatgccatttatccatcatgaacatgttcaccaaccctttgcacagtctcatcagcccccacctgatgcaagttttggattggcccggccccggtga

SEQ ID NO: 4311 - DNA, 4386 bp, Glycine Max
atggaggggttttggagcatgttttgtgggaaatctgatccttccacatgtgtcaaccatttgctgtttatttgcattaatgtgttgctgctgatcatgatcttatttacaatcctcaagaagtcatcacagaaaccatctcaaggtctaatccaagtgcaaagttattccaaattgcagctagtgtctgccatagccaatggctctctggggctaatacatttgtgctcaggcatttggcttttagaggagaatctgagaagaacacaaacagctttgcctcttgattggtggatgctcgaaagcatccagggattgacatggttgctggtgggttttacaataactcttcagctgaaacaatttccaagagcatggttatatatattttctgttgtaatctttatggtttctggtattctctgtgctttgtccttgttttatgcaattagtaccagaaaattgtccctgaaagtagctttagatgttttatcttttccagggataattttattggcactatgcacttacaaggaatctaagtatagagacactgagagagaaaataatgaaagtctatacacccctttaaaagaagagtccaataaagttgattatgttagttatgtcacactatatgcaaaagctggacttttcagtaggatgtcattttggtggatgaatccattaatgaaaaggggtgaagagaaaacacttcaggatgaggacataccaaagttgggggaggcagatcaagcagaaagttgttattttctgtttctagaccaattgaacagacagaaacagaaagaaccatcatcacaaccatcaattttgaagacaataattatgtgccactggaaggagattttgatatcaggattctttgcattgctaaaggtagtcactctctcatctggccctttgcttctgaattcctttatattggttgctgagggtcatgagagtttcaaatatgaaggttatgtgttggccatatcactggtctttacaaagatcatagaatccttgtcacaaaggcagtggtactttcgcaccagactcattggtattaaagttagatcactgctcattgcagcaatttataaaaagcaactgaggttgtccaatgctgcaagattggtgcactctggtggtgagataatgaactatgtgaatgtggatgctaatagaattggagagtttccctactggtttcaccagacatggacaacaagcgtccaactgtgtattgcattagtagtgcttttccgtgctgttgggctagcaacatttgcctcattggcggtgatagttctaactgtgctttgcaatactccacttgctaagttgcagcataagtttcagagaaaacttatggtgtcacaagatgagagattgaaggccacttctgaggctcttgtgagcatgaaggttttgaagttatatgcatgggaaaccaatttcagaaatgcaattgaaaggttgagggatgtggaactcaaaaggttgtctgcggtgcaattaagaaggtcatatagcaactttctcttttgggcctcacctgttttggtctctgctgcttcctttggggcttgctacttgcttaatgttcctttgcatgcaaataatgttttcacttttgtggcaactttacgccttgttcaagatcctattagaaccatccctgatgtcattggagtggtcattcaagcaaaagttgcatttgcaaggattgttaaatttcttgacgcgcctgaactgcagagtgaaaatgccaagaaaaggtgttttagtgaaaatatgaggggctcaattttgataaattcaactgacttttcatgggaaggtaacatgtcaaaaccaacactgagaaacataaacttggaggttggaccagggcaaaaggtggcaatctgtggtgaagttggctcaggaaaatcaactctcttagcagcaattctcagagaagttcctattactcgtggaactattgaagttcatgggaagtttgcctatgtttctcaaacagcatggatacagacaggtacaatacgggataatatattgtttggagcagctatggatgctgaaaaatatcaagaaacacttcataggtcttcactagtgaaggaccttgagttgtttccagatggtgatcttactgaaataggggagaggggggtcaacctgagtggcggtcagaagcagcgaattcaacttgctcgcgctctttatcagaatgctgatatatatctcttggatgatccatgcagtgctgttgatgcacacactgccacaaatttgtttaatgattacatcatggaaggacttgcagggaagacagtcttactggtgactcatcaagttgattttcttccagccttcgattctgttttgttgatgtctaatggggaaatcatacaagctgctccttatcatcatctgttgagctcaagccaagaatttcaggaccttgtcaatgctcacaaggaaactgctggttctaataggcttgtggatgtctcttcttccaaaggagactcaaatactgccacagagattagtaaaatatacatggacaaacagtttgaaacatcacaagaaggtcaattaattaagaaggaagagaaagagaaaggaaacaaagggttcaaacctcacttacagtatctgaatcaggacaaaggatatatatacttctatgtggcttctctttctcaccttatatttgtgattggccagatatttcagaacttatggatggcttctaatgttgacaatccttatgtcagcacattgcaattgatttttgtgtacttgttgatagggtttatttctgcatgtttcttgttcatcagaagtcttgttgtagtttctatgagtattcgatcatcaaaatctttatttttacaactactaaactccctatttcgtgcacctatgtcattttatgactccactcctttgggaaggatacttagtagggtctcctcagatctaagcattgtcgatcttgatgtcccatttggccttatttttgctgtgggagctactacaacttgttattcaaatcttgcagttatagcagccatcacttggcaagtcttgtttatctctataccaatgctttacatagcatttcgcttgcagagatattactatgccactgcaaaagaattgatgcggatgaatggcacaacaaaatcctttgtagctaaccatcttgctgaatctattgctggagttgagacaataagggcttttgaggaggaggatcgtttttttgcaaagaatcttgatctaattgatgtcaatgccagtccttattttcatacctatgcagcaaatgagtggttaatgctaaggttagaaacaatcagtgcagtggtctttgcatccgctgcactttgcatggtggtacttccacctgggactttcacctctggatttattggcatggctctctcttatggcctttcattaaactcttccctagtattttcaattcaaaaccaatgcactctagcaaatcaaataatatcagtagagaggctaaatcaatacatgcatataccaagtgaggccccagaagtaatagagggaaatcgtcctcctgtgaattggccagctgagggaaaagtagaattacatgatttggagataaggtaccggcctgatgcgccactagtactacgtgggatcacatgcacatttgaaggagggcacaagattggtgttgttggcagaacaggcagtggaaaatccactcttataggtgccttattccgtctagtggagccagcaggtggaaaaataatagttgatggcatagacatttgttctattggacttcatgacttgaggtcacgctttggtatcatacctcaggatcctactcttttcaatggcacagtcagatacaatatggaccccttatctcagcactcagataaagagatatgggaggttcttaggaagtgtcagttgagagaagttgttgaagagaaggaagaagggttggactcctcagttgttgaagctggggcaaattggagcatgggacaacgacaattgttctgcttggggcgttcccttttgaggagaagtcggatactagtgcttgatgaagcaactgcatcaattgataatgcaacagatttgattctacagaaaacaattaggacagagtttgcagattgtactgtaatcacggttgcccacagaataccaactgtgatggattgcactaaggttcttgccattcgtgaaggagaattggtggagtatgatgagccaatgaacttgatgaagagagaaggatcactgtttggacaacttgtcaaggaatattggtctcatttgcagtctgctgaatcacattaa

SEQ ID NO: 4312 - DNA, 561 bp, Glycine Max
atggaggtccgttccaatcccgccgccgacaactcctccgaccaccttcgaccgcccgccgtttcgtccaagcagccgctgccttctcctaccgccgtcgacacctccgccgtttctcagagactccagaaggaattaatggctctcatgatgagtggaggagatctcggggtgtcggcttttcctgatggagagagtatttttacatggattggcacaattgaaggtggaaaagggactcagtatgagggtttatcttataaactctccttacgttttcccctagactatccttttaagcccccccaagtgaagtttgagacaatgtgctttcatccaaatgttgaccagtttggcaacatttgtctggacattcttcaggacaagtggtcttcagcttatgattgcagaactattcttctgtctattcaaagtttattggaagagcctaacctggagagtcctctaaacagctatgctgcagcactttggaatgataaggaagattataggagaatggttcacaaacagtatttttctggagaggctcttgaaagctga

SEQ ID NO: 4313 - DNA, 582 bp, Glycine Max
atggaggttgagttggggctgaaaatcacaacgaccagagatgataccacttccgtttccgattttcaatttgccaaagacagatcaggacctgtcttcttgtctaaagaaactgatgcaaagctcatcctcactgcacatcttaaaggatataagaaggagaacattgacatcaatatcaataaagatggtagtgagatttcggtgagtggagagaaggaggtgcaggaaatgcaaatgataccgttcaagaaagtgctaaaaaccatagggtttgagaagaagtttagtattcctgatggggtggttttggatcagatcaaggctaagtataacgaaggggatgaagttttgacaattgtgatgccaaaaacggaagtgggaaaaggaagtagagaaattgaggaggtgaaagaagaagtacccgagtcaagtgtacaagaaaatgttgttgatagcgtgacaccagagccacaggaaagtgtgccagaaaagattgaagaggaaacacctgcagtgaagaagccccaaaaaccatggacaccttgtcctcctttggtttttggaggatcaactttgctt

SEQ ID NO: 4314 - DNA, 669 bp, Glycine Max
atggagtacaaagtgaaaaccacaacatcaacaccttctccaccaatcccaatccatgttcccactatgctgtcaaactctcctccatcttcatcttcttcacctccttcacaatctcccactcctttcccttcaccctctctgggctctccctctgctgctccaccgtctccgccgccgcctctgccaccggtggtggttagcccttgtgctgcctgcaagatcctccgccgtaggtgtgtggagaagtgtgtgttggctccatatttccctcccactgatcctctcaagttcaccattgctcatagagtctttggagccagcaacatcatcaagttcttgcaggaactgccagaatcccagagagaagatgctgtgagcagcatggtttatgaggcaaatgctaggatcagagacccagtttatgggtgtgctggtgcaatatgccaacttcaaaagcaagttagtgagctacaagcacagctggccaaagcacaagctgaggtagtgaacatgcagtgccaacaagccaatttagtggcgcttatttgcatggaaatgagtcaatcacaggagcagcacgtgcttcagcctcaaactcacgttgatatgagctgcttcatagaggacaacagttttgggactgcttgggagcctctttggacatga

SEQ ID NO: 4315 - DNA, 207 bp, Glycine Max
atggagtcgccggagtgcccggtatttcttcaatccttcgacgagcgcgacgcaattcctcgtgtcttatcatgtggacactcctatttatactcttgtattcaactaagtcgtccatatataaatgtggacttcgtaaaaattaattccaatggtgttcgtgatggggtgcaagggcacatgcagtgcacatgtagtagggtttaa

SEQ ID NO: 4316 - DNA, 486 bp, Glycine Max
atggatacagaggacttcagcttccccaaaaatggtggcacttgtgcatatagcattgattcacctcctctgtggaatatatcaccaaaagacccttctaatccaaatcaagtccctagagaaggaagcaaagcagatgaaaaggattactttgaagcaaaagtggtctctaagggccacaagaagagcttttcatgtgtcgaagatcgaaagaaaataacaagattaaccgatgaagcggctccaatggacttgttgtgggaggctttcaatgaggacctgtcttcagcagtaaagttttcttcctcttcttcaagggagatggttgaattcagatgcgctactacagccttaacagttgtcaagaccaacaaggctcttcttcaaacaaagaataggcccggtatggtggtgattgtaaaagtcttaaagaagttcttttctctcaataattctcatgtaaagttattttggcaatcagactaa

SEQ ID NO: 4317 - DNA, 3288 bp, Glycine Max
atggataccaaggggagactggttgcagggtcacataacaggaatgagtttgttctcatcaatgctgatgaaactgcaagagtgaatgctgttacagaattgagtggacaaatttgtcagatctgtggggatgagatagaggttactgttgatggtgaaccatttgttgcttgcaatgaatgtgcattccctgtgtgtagaccttgctatgagtatgaaaggagagagggaaacaaaatttgccctcagtgcaaaaccatatacaagcgcctaaagggtagtcctagagttgagggtgatgaggaagaagaggacattgatgatttggaaaatgagtttgacattggaagcaatatcaggcatgaccctcatcacgttgctgaggccttgctctcggctcgcctcaatgctgcccgtggttcacaaatgaacgctccagggatcaccacaccatcagagtttgatgcagcttctgtggcggctgatattcctctcctgacatatgatcacgaggatgttgggatttctgctgataaacatgctttaattattcccccattcatgcatcatgggaaacgggttcatccaatgcctcctgattcatctgtgccagttcaacccagacctatggatcctaaaaaagatttagcagtttatggatatggaagtgtcgcatggaaggaacgaatggaggaatggaagaaaaggcagaatgaaaaaattgaggtggttaagcatgaagggggtaatgatggtgggaaaaatggtgatgagcttgatgatccagatttgccaaaaatggatgaaggcagacagccactgtggaggaagttgccaattagcccaagcaagattaatccctatcgaattataatagtactccggattgctgttcttggtctctttttccattatagaattctccacccggtcaatgatgcatatgcattgtggctaacatcagtaatatgtgaaatctggtttgctgtgtcttggattttggatcagtttcccaaatggtgcccaattgagagagaaacataccttgatcgtttgtcatcgaggtatgagaaagaaggaaagccatctgaattagctgatatagacgtttttgttagtacagtagatcctatgaaagaacctccacttataactgcaaatacagtactatccatccttgctgtagattatccagtggagaaagtttcatgttatgtctcagatgatggtgcagctatgctgacatttgaagccatttcagagacttcagagtttgcaagaaagtgggttccgttctgtaagaagttcaacattgaacctcgggctcctgagtggtattttgctcaaaaggttgactatctgaaagacaaagtggatgcaacattcatcagggagcgtcgtgctattaagagggagtatgaagagttcaaagtgcgtatcaatgcattggttgcaatggcacaaaaggttcctgaggatggctggacaatgcaggatgggactccgtggcccgggaacagtgtcagagatcatcctggaatgattcaggttttccttggtcaaaatggtattcataatattgaagggaatgagttacctcgtcttgtctatgtgtcacgtgagaaaagaccaggatatgaacaccacaaaaaagctggtgctatgaatgccttagtgcgagtctcagcagtcatatcaaatgctccttacctactcaatgttgattgtgatcactacataaacaacagcaaagcacttcgtgaagccatgtgcttcatgatggatcctacatcagggaaaaaaatatgctatgtacaatttcctcaaagatttgatgggattgatcgtcatgatagatactcaaatagaaatgttgtattctttgatataaacatgaaaggtttagatggcatccaaggaccaatatatgtgggaactgggtgtgtctttaggcggcaggcgctctatggatatgatgcccctgctacgaagaaaccaccaaggaaaacctgtaactgttggcccaaatggtgctgcctgtgttgtggatctaggaacaagaataggaaagtgaagtcaggtccaagaaagaaaataaaaaacaaggatgctacaaagcaaatacatgcactagaaaatattgaagagggaattgaaggaattgacagtgagaagtcatggttaatgtcacaactaaaatttgagaaaaaatttgggcaatcagctgttttcatagcctcaacacttatggaagatgggggtattctaaaaggagcaacttctgcatcactcttgaaagaagccattcatgtcatcagttgtggttatgaagataagacagagtgggggaaagaggttggatggatatatggttctgttacagaagatatattaacaggtttcaagatgcactgtcatggttggcgatccgtgtactgcatgcctaaaaggcctgcttttaagggttctgctcccataaatctttcagatcgtctgcatcaagttctccgttgggcacttggatctgttgagatcctgttgagtaagcattgtcctatatggtatggatatggttgtggcttgaaatggctggagcgtttttcttacataaactcggtcatttatcctttgacatcacttcccttaattgcctattgcaccttgccggctgtctgtcttctcactggaaagttcatagtccctgagattagcaactatgccagtatcattttcatggcactcttcatctccatagctgtgactagcatccttgaaatgcagtggggaggtgttggcatacatgactggtggaggaatgagcagttctgggtcattggtggtgcctcctcacacctctttgctctcttccagggtttgctcaaggttctggcaggagttaacacaaacttcacagtcacatcaaaagctgcggacggcggagactttgctgaactctacctcttcaagtggacatcattgttgatccctcctttgaccttgctcatcataaacataataggagttattgtaggtgtttcagatgcaataaacaacggctatgattcatggggtcccctatttggtaagctattttttgctctttgggtcattgtccatctttaccccttcctcaagggagtcatgggaaaacaggaaggtgttcccaccatcattttggtttgggctattcttctggcttcaatcttctcacttctgtgggtgaggatcaacccatttttgtcaaaaggtggcattgtgttggaactttgtggcttgaattgtgactag

SEQ ID NO: 4318 - DNA, 1017 bp, Glycine Max
atggatcacagtgccgatgctcaacgcacggacttgatgaccatcacccgcttcgtgctgaaccaacaatccaaccaccctgagtctcgtggcgatttctcaatcttgctcagtcacattgttctcggttgcaagttcctctgctctgctgttaacaaggcgggtcttgctaagcttattggacttgcaggagagacaaatgttcagggcgaagagcaaaagaaactggatgtcctttccaatgatgtctttatcaaggctttggtcagcagtggacgaacatgcatcttggtgtctgaagaagatgaggaagcaacatttgtggaagcttctaagcgtggaaaatactgtgttgtttttgacccgctggatggttcttctaacattgattgtggtgtttcaattggcacaatctttgggatttatttgataaaagaagaccatgaaccaaccattgaagatgttttgcaacccgggaagaacatgttggcagctggttattgtatgtatggaagctcttgcacgcttgtgttaagcactggaagtggtgttaatggtttcacccttgatccatctcttggggaattcattctaactcaccctgacatcaagattccaaagaaaggcaagatctattcagtgaatgaaggaaatgctaaaaactgggatgaccctactaccaagtatgtggagaactgcaagtatccaagagatggttcatcaccaaagtccctaagatatattggaagcatggtagctgatgttcaccgcacattgctttatggaggtatttttctgtatccggctgataaaaagagtccaaatggaaaacttcgtgtactctatgaagtcttcccaatgtcattcttgatggaacaagcaggaggacaggctttcactggcaaccaaagggcacttgatttggttccaaagaagttgcacgagcgatctcccatattccttggtagctatgaggatgtcgaggaaatcaaggctctttacgctgctgaggaatga

SEQ ID NO: 4319 - DNA, 960 bp, Glycine Max
atggatcacagtgccgatgctcaacgcacggacttgatgaccatcacccgcttcgtgctgaaccaacaatccaaccaccctgagtctcgtggcgatttctcaatcttgctcagtcacattgttctcggttgcaagttcctctgctctgctgttaacaaggcgggtcttgctaagcttattggacttgcaggagagacaaatgttcagggcgaagagcaaaagaaactggatgtcctttccaatgatgtctttatcaaggctttggtcagcagtggacgaacatgcatcttggtgtctgaagaagatgaggaagcaacatttgtggaagcttctaagcgtggaaaatactgtgttgtttttgacccgctggatggttcttctaacattgattgtggtgtttcaattggcacaatctttgggatttatttgataaaagaagaccatgaaccaaccattgaagatgttttgcaacccgggaagaacatgttggcagctggttattgtatgtatggaagctcttgcacgcttgtgttaagcactggaagtggtgttaatggtttcacccttgatccatctcttggggaattcattctaactcaccctgacatcaagattccaaagaaaggcaagatctattcagtgaatgaaggaaatgctaaaaactgggatgaccctactaccaagtatgtggagaactgcaagtatccaagagatggttcatcaccaaagtccctaagatatattggaagcatggtagctgatgttcaccgcacattgctttatggaggtatttttctgtatccggctgataaaaagagtccaaatggaaaacttcgtgtactctatgaagtcttcccaatgtcattcttgatggaacaagcaggaggacaggctttcactggcaaccaaagggtaatttaccaaaaacagggcgaaaaacaaaaaattagtttagactaa

SEQ ID NO: 4320 - DNA, 1524 bp, Glycine Max
atggatccaaaaggaagcttatgtgctaaaaactgcacaaggacctcttccttaacttctcctgggaatggactacaaacaaatttgtcctctgatcctccctctttctatggggtcaggattgaatcacctttcaaagaattcatccaaccctctcctccaactcaatctgtacttccaggtgaatctaatgcagatattgatatccctgaccaggaaaattgtccactgagtaactcatcacataccagtaaactccaagattggaatccaagtgcaatgttgaataacctttccttcctcgaagaaaagattcatcagcttcaggatctagtgcatgtaattgttaataaaaagtgccaaccttttggacaacctcatgaactggtgactcaggaacagcagctcatcacagccgatcttacatcgatcattgttcaattgatctctactgctggtagtcttctcccctctgttaggcacaccctcacaaacacaaatcccttggttggccagcttgaccagcttcatgggattaacctcccttttggatcagaaccaagtagtggtattaggccacaaaataacagtggaaataaactgtttgatcagtccactcagaatgatctaccaaataaattggaaatggaacaaaactacaatatggaagagcatgagccaaaagatgaagaagatgcggatgagggagaaaatcttccacccggttcctacgagattttgcaattagaaaaagaagaaatcctcgctcctcatacacatttctgtacaatatgtgggaaaggattcaagagggatgcaaatctccgaatgcacatgcgtggccatggtgacaagtacaaaactcctgcagctcttgcaaaaccacacaaagaaaccgggtctgaaccaaagcttatcaagaggtattcctgcccctatgccggctgcaagcgtaacaaggatcacaagaaattccaaccactaaagaccattttgtgtgtcaaaaaccactacaagagaacacactgtgacaagagctacacttgcagcagatgcaacaccaagaagttttcagtcatggcagaccttaaaactcatgaaaaacactgtggtaaggataaatggctttgttcatgtggcacaacattttcaaggaaagacaagctttttggacacattgctctattccaaggccatacacctgctattcctttggatgataccaaaggagtggctgagccacctgatatccagaacagagaaagcaacaataaggtagaaagtattaatttctgttttggatcaaatccttcaactgaaaacgtagttcaaaacatcatggacatgaaaggtaatattgatgatcccatgaattatttctcatcgttgaacttcgaaggctgtaactttggggcgtttaatgaattctcccaacctccatttgaagattcagaagcttctttctctttccccatgtcgggatcctataattatgctcccaaatttgacagcgacaatttataa

SEQ ID NO: 4321 - DNA, 1443 bp, Glycine Max
atggatcctcatactgaagagttgcctcagtacatacatataaatcagaatgagttttgcatacgaaggcataagaagcagaaggaggaggatattgctatatgtgaatgcaaatatgatgctgatgaccctgacaatgcatgtggggatagctgcctgaatgtattaaccagcactgaatgcacccctggttattgtcattgtgatatattatgcaaaaatcagaaatttcagaagtgtgaatatgcaaaaacaaagttgtttaaaactgaaggccgtggatggggtcttttggctgatgaggatattaaggcaggacaatttgtcattgaatactgtggagaagtaatatcatggaaagaagccaaacgtagatcccaggcttatgaaaatcaaggtcttaaagatgcatttatcattttccttaatgtgtctgaatctattgatgcaaccaggaaaggaagccttgctagatttataaatcattcctgtcaaccgaactgtgagacgagaaaatggaatgtgttgggggaaataagagttggaatatttgcaaaacatgatattcctattggaactgagttagcttatgattataattttgaatggtttggtggtgccaaggttcgttgcctctgtggtgcactaaaatgttctggattccttggagcaaaatctcgaggttttcaggaggatacttatctatgggaagatgatgatggcaggtactcagttgagaaaattcctgtatatgattctgcagaggatgaaccggtgtcaaattttaatggacgaaccgaaccctctttggatgttatagttaaagctgagcaattatcggagtccactgctttccatgttcagccccttgattcagttcagatgaaagatttagatgttaagaagattaaaactgatgtagcagacgaggatatgaacttttattcacaggatagtgaacataccctttctcaaaagaatgcaatatcacatatccgaagtaatactgcaggcagaaactattgccttggacctaggtccatgtctaccaaaagatcaagggcatataatggtggaaggttcaaaaatctcatagagaagaagatcgatgttaagtttgctgctgccctcctagcatccaaggaagcacaagaggagatttttaattgtgagaaaatgaaggatgatgctacatctgctcttgattccttatatgatgaaatacggcctgccattgaagaacacgagagggatagccaagacagtgtatccacgactgtagcagagaagtggatacaggcttgctgcctgaaattaaaggcggagtttgacctttactcatccattgtcaaaaatgttgcttgcactgcgcaaagggcatctggccaagtaaaacctactgaagttgataacgaaaacgaaattaagctcctgacaggttga

SEQ ID NO: 4322 - DNA, 2361 bp, Glycine Max
atggatgcctctccctcaagtatgaaacttcttaaattccttttactttgcttgctatgtacaatcttgttcaactctgtcatgtgcagttccaagattcattgcaacgagaaggacatgaacacactcctacgctttaaaacaggagtcacagatccttcaggtgtgctctcctcatggtttccaaaattagattgttgtcaatggactggagtcaagtgtgataacatcactggaagagttacacatcttaatctcccttgtcacacaactcaacctaaaattgttgctttggatgagaaggatgacaaatcacactgcctaactggcgaattcagccttactttacttgaacttgaatttttgagctacttgaatttcagcaacaatgacttcaagtctatccaatacaattcaatgggtggtaaaaaatgtgatcacttgtcaagaggtaaccttcctcatctttgtcgaaactccaccaacctccattatcttgatttatcattcaattatgatcttcttgtcgataatctccattggatttcccgtctttcctcattgcaatatcttaaccttgacggtgtccatcttcacaaggaaattgattggcttcaatcagtcaccatgctcccttcacttttagagttgcacttgcagaggtgtcaacttgaaaacatctatccatttcttcattatgctaattttacttcacttcgagttctaaatcttgctgacaatgattttctatcagagttgcctatttggttattcaatcttagttgtgacatctcttatattgagcttagcaaaaatcagatacatagccaactacccaaaacattgccaaatcttagaagtattaagtccttgtttttgtctaagaatcatctcaaaggacccattccaaattggttaggacaacttgaacaactagaagaacttgatttttctcaaaattttttatccggtccaatccccacaagtttgggaaatttatcttctttgacaactttggtactcgattcaaatgagttgaatggaaatcttccagacaatctcaggaatctcttcaacttggaaacactttcaatttcaaaaaattccttgactggaattgtgtctgaaagaaatttactttctttttcaaaattgagatggtttaagatgagttcccctggcctgatctttgattttgatcctgaatgggtccctccttttcaacttcaacttcttgaattgggctatgtgagagacaaacttcctgcatggctattcacacagagttctctaaaatatctaaccattgtagattcaactgcttcatttgaacctcttgacaagttttggaactttgctactcaacttaaatttttctttctggtaaacaacactatcaacggggacatatcaaatgtgttgctgagttcggaatgtgtttggttagtttccaataatttaagaggtgggatgcctcgtatatcaccagatgtggttgttttaactttatataataattcattgtctggatccatttctcctctcttgtgtgacaataggatagataaaagcaatttagtgcatttggacatgggttataaccatttaacgggagaactcacagattgttggaatgattggaaatcgctggttcatattgatttaagttacaacaacctaacaggaaagattcctcactcaatgggctccttgtctaatcttcgttttctgtatctggaaagcaacaagttctttggaaaggtacctttttcactaaataactgcaagaatctttgggtacttgatcttggtcacaataatctttctggagttataccaaactggttgggtcagagtgtgagaggtgttaaattgagatccaatcaattcagtggaaacattcccacacagctatgccaacttgtaatgcttcaacccttaaagtcggctatatgtattacgatgcttataaaagggaacgagttagaatattttaatttaatgaatgtgattgatctctcaaataacatcttgtctggaagtgtgcctttagagatatatatgctcactggactacagtccttgaatttgtcccataatcaattactgggaacaataccacaagagattggcaacttggaactattagaatccattgatctctcaagaaatcaattctcgggagaaattccagagtccatggctgacttgcattatctttcggtcttgaatctgtcattcaacaattttgtggggaaaatcccaacagggacccaacttggttccacaaaccttagctatatcggcaatcctcacctttgtggagctccacttacaaagatatgcccacaagatgaaaag

SEQ ID NO: 4323 - DNA, 2511 bp, Glycine Max
atggatgcctctccctcaagtatgaaacttcttaaattccttttactttgcttgctatgtacaatgttgttctactctgtcatgtgcagttccaagattcattgcaatgagaaggacatgaacacactcctacgcttcaaaacaggagtcacagatccttcaggtgtgctctcctcatggtttccaaaattagattgttgtcaatggactggagtcaagtgtgataacatcactggaagagttacacatcttaatctcccttgtcacacaactcaacctaaagttgttgctttggatgagaaggatgacaaatcacactgcctaactggtgaattcagcctaactttacttgaacttgaatttttgtggtacttggattttagcaacaatgacttcaagtctatccaatacaattcaatgggtagtcaaaaatgtgatcagttgtcaagaggtaaccttcctcatctttgtcggaactccaccaacctccgtttacttgatttatcattgaattatgatcttcttgtcgataatctccattggatttcccgtctttcctcattgcaatatcttagccttgaaggtgtccatcttcacaaggaaattgattggcttcaatcagtcaccatgctcccttcacttatagagttgcacttgcagaggtgtcaacttgaaaacatctatccatttcttcagtatgctaattttacctcacttcaagctctaaagctgtctggcaatgattttgaatctgagttgcctagttggttattcaatcttagttgtgacatctcttacattgaccttagccaaaataagatacatagccaactacctaaaacattgccaaatcttagaagagttaagttcttgactttatctcaaaattatctcaaaggacccattccaaattggttaggacaacttgaacaactacaaggacttgatctttctcataattttttttctggtccaatccctgcaagtttgggaaatttatcttctttgacaactttggtactcgattcaaatgagttgaatgaaaatcttccagacaatctctggcatctcttcaacttggaaagactttcaattttaaaaaattccttgactggaattgtgtctgaaagaaatttactttctttttcaaaattgagatggtttgccatgagttcccctggcctgatctttgattttgatcctgaatgggtccctccttttcaacttcaacatcttacattgggctatgtgagagacaaacttcctgcatggctattcacacagagttctctaaaatatctaatcattgaagattcaactgcttcatttgaacctcttgacaagttttggaactttgctactcaacttaaatttttcaatctggtaaacaacactatcaacggggacatatcaaatgtgttgctgagttcggaacatgtttggttagcttccaataatttaagaggtgggatgcctcgtatatcaccagatgtggttgctttaactttatataataattcattgtctggatccatttctcctctcttgtgtgacagcatgaaaaataaaagcaatttagtgcatctggacatgggttataaccatttaacgggagaactcacagattgttggaatgattggaaatcgttggttcatattgatttaggttacaacaacctaacaggcaagattcctcactcaatgggctccttgtctaatcttcgttttctgtatctggaaagcaacaagttctttggagaggtacctttttcactaaataactgcaagaatctttggatacttgatcttggtcacaataatctttctggagttataccaaactggttgggtcagagtgtgagaggtcttaaattgagatccaatcaattcagtggcaacattcccacacagctatgccaacttggttccttaatggtgatggattttgcaagcaatagattatcaggaccaatacctaattgcttacataacttcacagccatgctttttagtaatgcttcaacccttaaagtcggctttatagttcacttaccagggaacgagttagaatatatgaatttcatgaatgtgattgatctctcaaataacatcttgtctggaagtgtgcctctagagatatatatgctcactggactacagtccttgaatttgtcccataatcaattactgggaacaataccacaagagataggcaacttgaaacaattggaggccattgatctctcaagaaatcaattctcgggagaaattccagagtccatggctgtcttgcattatctttcggtcttgaatctgtcattaaacaattttgtgggggaaatcccaacagggacccaacttggttccacaaaccttagctatatcggcaatcctcacctctgtggagctccacttacaaagatatgcccacaagacgaaaattttgggcgccattttcttcaaccggagatgcaggcatgcttattttcgatttctgcaccgaatgtatga

SEQ ID NO: 4324 - DNA, 2484 bp, Glycine Max
atggatgcctctccctcaagtatgaaacttcttaaattccttttactttgcttgctatgtacaatgttgttctactctgtcatgtgcagttccaagattcattgcaatgagaaggacatgaacacactcctacgcttcaaaacaggagtcacagatccttcaggtgtgctctcctcatggtttccaaaattagattgttgtcaatggactggagtcaagtgtgataacatcactggaagagttacacatcttaatctcccttgtcacacaactcaacctaaagttgttgctttggatgagaaggatgacaaatcacactgcctaactggtgaattcagcctaactttacttgaacttgaatttttgtggtacttggattttagcaacaatgacttcaagtctatccaatacaattcaatgggtagtcaaaaatgtgatcagttgtcaagaggtaaccttcctcatctttgtcggaactccaccaacctccgtttacttgatttgtcattgaattatgatcttcttgtcgataatctccattggatttcccgtctttcctcattgcaatatcttagccttgaaggtgtccatcttcacaaggaaattgattggcttcaatcagtcaccatgctcccttcacttatagagtttcacttgcagaggtgtcaacttgaaaacatctatccatttcttcagtatgctaattttacctcacttcaagctctaaatctgtctggcaatgattttgaatctgagttgcctagttggttattcaatcttagttgtgacatctcttatattgaccttagccaaaataagatacatagccaactacctaaaacattgccaaatcttagaagagttaagttcttgattttatctcaaaattatctcaaaggacccattccaaattggttaggacaacttgaacaactacaagaacttgatctttctgataattttttttctggtccaatccctgcaagtttgggaaatttatcttctttgacagatttggcactcgattcaaatgagttgaatggaaatcttccagacaatctcgggaatctcttcaacttggaaacactttcaattttaaaaaattccttgactggaattgtgtctgaaagaaatttactttctttttcaaaattgagatggtttgccatgagttcccctggcctgatctttgattttgatcctgaatggatccctccttttcaacttcaacatcttacattgggctatgtgagagacaaacttcctgcatggctattcacacagagttctctagaatatctaatcattgaagattcaactgcttcatttgaacctcttgacaagttttggaactttgctactcaacttaaatttttctttctggtaaacaacactatcaacggggacatatcaaatgtgttgctgagttcggaacgtgtttggttagtttccaataatttaagaggtgggatgcctcgtatatcaccagatgtggttgttttaactttatataataattcattgtctggatccatttctcctctcttgtgtgacaataggatagataaaagcaatttagtgcatttggacatgggttataaccatttaacgggagaactcacagattgttggaatgattggaaatcgctggttcatattgatttaagttacaacaacctaacaggaaagattcctcactcaatgggctccttgtctaatcttcgttttctgtatctggaaagcaacaagttctttggagaggtatcttcactaaataactgcaagaatctttggatacttgatcttggtcacaataatctttctggagttataccaaactggttgggtcagagtgtgagaggtcttaaattgagatccaatcaattcagtggcaacattcccacacagctatgccaacttggttccttaatggtgatggattttgcaggcaatagattatcaggaccaatacctaattgcttacataacttcacagccatgctttttagtaatgcttcaacccttaaagtcggctatatagttcacttaccaggttttccagtaatcatgacagctagtattacgatacttataaaagggaacgagttagaatattttaatttaatgaatgtgattgatctctcaaataacatcttgtctggaagtgtgcctttagagatatatatgctcactggactacagtccttgaatttgtcccataatcaattactgggaacaataccacaagagattggcaacttggaagcattagagtccattgatctctcaagaaatcaattctcgggagaaattccagagtccatggctgtcttgcattatctttcggtcttgaatctgtcattcaacaattttgtggggaaaatcccaacagggacccaacttggttccacaaaccttagctatatcggcaatcctctcctctgtggagctccacttacaaagatatgcccacaagatgaaaag

SEQ ID NO: 4325 - DNA, 204 bp, Glycine Max
atggatgctgccaagaagatagattgcggtggcaagtgcaattccaggtgcagtaaggctaggaggcaaaaaatgtgcattagggcatgcaatagttgctgcaagaagtgcaggtgcgtgccacccggcacttctgggaaccgagatttgtgcccttgctatgctagactcaccacacatggaggaaagctcaagtgcccatga

SEQ ID NO: 4326 - DNA, 993 bp, Glycine Max
atggatgctttgaacttcctcaaattctggagaaacgccaccatgagcacaacctccgaaccccaccttgttgttgaaaccgacaccgaatccgacgaagacgactcattcttcgacttggagctcacgccactcgatttcgacaacaaagaaaacaacaccaacaccaccacaaccaaaaacgacgacgacccaaaacaaacgacaacaagcgaactcaaaagtcttggctccaaagacaacttactcagcaaaacagacaatggcgttcagcgtaaaacaccacttcccctgtctcctccttccgaacctatctccaaacgtaaggtcctcccaatcgaacctatctccaaacctcagtcccccattgcgcttctcaggtccgccccgagcttcagaatcttcatgttccgaaagcgaaacagaacacctccacaacagaaaacagagcactctgttaacgaagcaaaagtctttgcggtgaagctcagcgtcgacgattttcgttcctctcccgcgctcagcagggacaacagcacgagaagctttgggagcaaggttcggggtttgagctacgaggaagaaccgaagccggagcggttttcgaaggaggtgttgcggaagtacctgaagctgataaagccgctatatgttaaagtttctaagaggtatagtgataaggtgaggttctccggtgagggttatgcggcgtcgccgtcgtcgtcgccgtcggtcgcctctgtttcttcgaggacggagaaacaggggaaggggatgagggtggtttcgaagcatttaggaaagagtaggtcggcgtcgtcgacggtggcgggtgttagttctccggcgaagaagagcgatgacacgatgcagcagcagcttgatgggatccaaagcgccatccttcactgcaaaaggtccttcaactccagagaaggatcaatgtattcggtgaggaaatcatttgatggtgaacatggggaaaaagtgtaa

SEQ ID NO: 4327 - DNA, 615 bp, Glycine Max
atggattcttcttcatcagcaagtgttagtcagcatgccaaggttgttccaaaacaatttgacatcttcttccatgcaggaaggtacccttcatctcgcaggactcattcctcttcctcctcttcctcctttgaatcattctatttcccagaggatcctcttcttagtcctgcatcccctcttagattctctggtgttccattttcttgggaacacttgcctggaattcccaagaaacaaaattctaaaaagaagctgcaagagtcttccttgaaactactaccattgccccctccaactaccacacactgttcttctaaaaagcactctcatgaagaaacaaggattaggaaaaagaattcaatacaaagtgttttccaaagggatcctttctttgctgcacttgttgaatgctcaaaggatgataatgaagaaattacaagtagaaatttgtggaatggagctaaggtgccaataaggagtattagtgatcgttttgggtttattagcctttatgcctcttgcaagagaacttgtgctgtttctgaatctttagtctaccttccaagctcaagaagaagcacctgtgagcatgttagtcccaggtccctctaa

SEQ ID NO: 4328 - DNA, 1392 bp, Glycine Max
atggattgtagtaacgagttggatatgcaagaaccgagcattgagacggataagcttagttacgaaatcttctccattctcgaaagcaagtttctcttcggctacgacgatccaaagctctggttccccaagcaaatacctcccaagccggaatctcagactccggcagctaccgccgccgtggactgcgtctccgcagtcaagaaccagcgcggcaagatatgcattctcgccatcgacggcggcggcatgcgcgggattctcgccggaaaagccctcgcctacctggaagccgcgctgaagaagaaatccggcgaccagaacgccaccatcgcagactacttcgacgtggccgctggcgccggagtcggcggcatcttcacggcgatgctcttctccaccaaagaccaccgccgcccgattttctccgccgacgacacgtggcggtttctggcagagaaaggaaacaaattctaccgcgcgggaggcagcgcaagcaaccgggggttgctgaagaggttactttccagtggaggttccggctcggtgtcgtcggcgacggcgggtttggagaaagcggtgaaggaagcgttcacggcggagaatggtggtgggagtttgactctaaaggacactctaaaaccggttctgattccgtgctacgacttatcgagtacggcgccgtttttgttctcacgtgcggacgcgttggaaacggatagcttcgacttccggttgtgggaggtatgtcgtgccacctcggccgaaccgggtttgttcgaaccggttcagatgcgttccgtggatggtcaaacaaagtgcgtggccgtggacggaggtttagcgatgagtaacccaacgggggcggcaatcacgcacgtgctgcacaacaagcaagagtttccgttcgtgcgaggcgtggaggaccttcttgttctgtccctcggaacgggtcaactattggaggtgagttacgactttgaccgagtcaaacgctggaaggccaaggattgggccaggcccatggcccgcatttccgccgacggctcctctgacctcgtcgaccaggccatcgccatggcctttggtcagtgccgcagcaccaattatgtccgcattcaggcaaatgggtcaagtatggggcgatgtggacccaatgtggatacagattcaagtcccggcaatgtgaagatgctagtaggaatagcagaagagatgttgaagcaggagaatgtagagtcagtactgtttggaggaaagagaattggggagcagagtaacttcgagaaacttgactggtttgctggagaacttgttcaggagcatcagaggaggagctgcagaatagctcccactgttgctttcaagcaagcaaccccaaaagcgacttag

SEQ ID NO: 4329 - DNA, 1737 bp, Glycine Max
atggatttggattggtcgtgttcttccaccaccaccaccaccaccggcaacccctactgtctcctcttccaagcgctatcactcattccaatctcgcactacctcctcttctcctccttcgttttcctctccttcctctaccgtttcctggagctccatttcctccaagacctcttctccctcttctccggctcctccgtcaccttaacctaccatcccgcttcccaattctacgacgccgtggtttccaaatgcaggattctccacggcacctacctcgccacgccctggctctccagccctcatctccagaccgtgtttctcaacttcttcggcagacctcccttcttcaaatacagaagacaactgtttactactcctgatggcggaaccgttgctttggactggctgttgagttctgacgtttctgctggtgctatccatatggaagatgttgtttctacagatgaatccactcccattgttgtagtaattcctggtctaacaagtgactcttcatctgcgtatctcaaacatcttgcatatcatacagcaaagtgtggatggaaagttgttgtcagtaatcaccgaggacttggaggtgtttcaatcacgtctgattgtttctacaatgctggatggactgaggatgtccgcacagtggttaattatctacacaaagagaacccaagggcacctttgtttgttgttgggactagcattggagctaatattctgataaaatatcttggtgaggatggtgagaatattcctgtagctggagctgtggctgtttgctctccttgggaccttttgataggagacagatttataacccgtaggcatgtgcagaagttttatgataaagcacttgcaattggacttcaaggttatgcaaaattacatcagcctcatttttctcgccttgctaattgggaagggattgaaaagtcaatttccattcgagattttgatcatcatgccacccgcattgttgggaagtatgagactgttgacacgtactatagacgctgcagcagttctacttatgtgcaatctgtttcgattccacttctctgtattagtgctctggatgatccagtctgtaccagggaagccattccctgggatgaatgcagggcgaataaaaatattgtcttggctactgtaaaacatggaggacatctggcattctttgaagggataactgcatctggcctttggtgggtaagagctgttaatgaattccttggtgaattacgtgctagccattttatgcatgtacagaagaagatcactaaaccaaccataccattggactcgtcaattgatcaaggcccttatgttaatgttaaggaagatggaatggtggctgcattgaacaatgagccaaaaactgacaacgtggaagaaatacaggtaatacaggatacagataatgacggtctagagatgattccagaagaaaaagtggttaaacaagatgagcttgagactaatgcaaagattcgaggttctcctggcattgctcaagcttgtgttcatgatgcagcagtgcatgtaataacacctttcaaaagagacctaggccagttatctcgacaaaatcgatggtccatctggttgctagtttatattgctattaccacaagttggcctctggttggttcggctctatatattgtgtttgggaaaaagataagggatatcctaccaaatggattagtcagaaaataa

SEQ ID NO: 4330 - DNA, 1017 bp, Glycine Max
atggatttggtggaaggcgtcggagagagttcctcgccgccgcgcgccttcagcggctacagcaactacgacgtccgcaacgatgtctacaaccgccttcttcaaaccggccacgaccaagccgtttccaaccccgacttccgcgaacacttggaggctcacttcaatcgcttgccaccgagttatggactcgatgtgaatatcgatagagctgaagatgttctgttgcatcaatcccttcttgctttggcaaaggaccctcacaagcgccctgtataccatatacgcttccttgagaatatttcaactagaacagatagtgaagatcaacaaattttaagtactcattatagcccaggatcatcttcccatgcaacaaatgggggagctgtatcacctggtaaaagtaagatgagggatattgcaaatgagtttgagccttgctcgaagcttgaggacctaaatttggatgttagaaagaactcaaaggagacagaggaaaaatttctctctgacaattttttccagaggcttgaacattcaagtgtccccgttcatgaaataatattttccactgttgacaagccaaagctgttaagccagctgtccgctttgctgtctgatattggacttaacatccgtgaagctcatgttttctccacaactgatggctattcccttgacgtgtttgtggtggatggatggccagtagaggaaacagatgatttgtatgatgctatggaaaaagctgtatcaagaagcgagggatcatggtctcgttctttaaaatctcattcagctgtggagaaagccttagcaacagaaggaaaatcaggagattgggaaatagataggaagttgctaaagttaggagaaaaaatagcatctggatcctctggagatttgtatcgtggagtttatctcggtgaagatgttgctgttaaggttctgagatcggagcaattgaatgatgccttagaggatgagtttgctcaagaagtggcaattctgagttga

SEQ ID NO: 4331 - DNA, 693 bp, Glycine Max
atggatttggtggaaggcgtcggagagagttcctcgccgccgcgcgccttcagcggctacagcaactacgacgtccgcaacgatgtctacaaccgccttcttcaaaccggccacgaccaagccgtttccaaccccgacttccgcgaacacttggaggctcacttcaatcgcttgccaccgagttatggactcgatgtgaatatcgatagagctgaagatgttctgttgcatcaatcccttcttgctttggcaaaggaccctcacaagcgccctgtataccatatacgcttccttgagaatatttcaactagaacagatagtgaagatcaacaaattttaagtactcattatagcccaggatcatcttcccatgcaacaaatgggggagctgtatcacctggtaaaagtaagatgagggatattgcaaatgagtttgagccttgctcgaagcttgaggacctaaatttggatgttagaaagaactcaaaggagacagaggaaaaatttctctctgacaattttttccagaggcttgaacattcaagtgtccccgttcatgaaataatattttccactgttgacaagccaaagctgttaagccaggaagttgtcaagagaggtttcaggctaagcaatttgatttttaactgtgccaaatggcataatgtgatccatgcaactgacctcacttag

SEQ ID NO: 4332 - DNA, 501 bp, Glycine Max
atggcaaggatcaaacctcaggctctgctacagcaaagcaaaaggaagaagggtccttcaaggataagcgccgcgactgttatattttatttcttgattcttgccttgcttgggtttttcctgtttgcttcgtacagacattggtccagcaggtcaagattgcaatcagaagatcacttgtcagtctccgagggtgaaaatacttttgtggactccaagaaatctgagctgcctggatatgctgttttaaatacctctaaaggttctataataatagaactgtacaaggaaagtgctcctgaagttgttgatgaattcattgacttatgtcaaaaagggcacttcaaggggatgctttttcacaaagtaattaagcactacgtgattcaggctggggataaccaaggacaaggagctactgaagactggaacttgagaggaaagcaacatacaattactaggttttcttattcttctggtttctgcaatttaagtttctga

SEQ ID NO: 4333 - DNA, 699 bp, Glycine Max
atggcaaggatcaaacctcaggctctgctacagcaaagcaaaaggaagaagggtccttcaaggataagcgccgcgactgttatattttatttcttgattcttgccttgcttgggtttttcctgtttgcttcgtacagacattggtccagcaggtcaagattgcaatcagaagatcacttgtcagtctccgagggtgaaaatacttttgtggactccaagaaatctgagctgcctggatatgctgttttaaatacctctaaaggttctataataatagaactgtacaaggaaagtgctcctgaagttgttgatgaattcattgacttatgtcaaaaagggcacttcaaggggatgctttttcacaaagtaattaagcactacgtgattcaggctggggataaccaaggacaaggagctactgaagactggaacttgagaggaaagcaacatacaattactagtatgaaacatgaagcattcatgcttggaacttccaagggcaaacaccacaacaagggatttgatcttttcattacaactgcaccaataccagatctaaatgagaaaattattgtgtttgggcaagtcatcaagggagaggatgttgtccaggaaattgaagaagtggatacagatgaacattacaagcctaaagtatctatcgggatacttgatgtgactcttaaacaaaaggtctga

SEQ ID NO: 4334 - DNA, 1098 bp, Glycine Max
atggcaatatatgaactggatcccgatgttgttcgctggggtcttcatctcctagatgattgcacactttcccaccattattcgcctagtattgtaactcaatatgatcctgatttaagtcaagttgaatatgttacagaaggcttttgtcagcatcagtatgtggatagtgacgaggctgttgcacaagcttatcaagaagaattatggcaacttgattccatggtagcttctgggatatccaattttgagaatgaaggaatgcaaggatctgtttatacacaagattggcctcagtcttcaaatggaaatgataacttaggcaatgaatcttgccagaactctgtaggtgagtcctataatatgaaagaagtggggaattatggtccaactccaagtgaaagaaaaaatgacgtgcatgaaaatgatgtttgtggttcgtcttctggatcagtagaggtacctgctactgctactagtgatgacttctgggattcattggaaatatcggatgaatctcttgatggtgaagttggcaaaagattaaaccagatggttcccattcctcatgttcctaaaaccaatgaaaaaataccatctgatgacgaagaaatatcagatcatcaaagacttctagacagattgcagttatatgatctgattgaatgcaaggttcaaggagatggtaactgccagtttcgttctttatcagatcaactctatcgttctccggaccaccacaaatttgtgcgggagcaaattattcaacagctcaaatattacccagatctgtatgctggttatgttcccttggcgtatagtgactatttgagaaatatgagcaaaagtggcgaatggggtgatcatgtcacattgcaggctgctgcagattggtatggcgtcaaaatttttgttattacgtcttttaaggatacatgttacatcgagattcttccacagatacagaagtctgaaagagtgatatttctgagcttttgggcagaggtgcattacaactcaatttatccagaaggagattcagaattgccctcatctcatacaaagaaaaagaagaaatggtggaattttgctggctag

SEQ ID NO: 4335 - DNA, 1098 bp, Glycine Max; identical to SEQ ID NO: 4334

SEQ ID NO: 4336 - DNA, 1110 bp, Glycine Max
atggcaatatatgaactggatcccgatgttgttcgctggggtcttcatctcctagatgattgcacactttcccaccattattcgcctagtattgtaactcaatatgatcctgatttaagtcaagttgaatatgttacagaaggcttttgtcagcatcagtatgtggatagtgacgaggctgttgcacaagcttatcaagaagaattatggcaacttgattccatggtagcttctgggatatccaattttgagaatgaaggaatgcaaggatctgtttatacacaagattggcctcagtcttcaaatggaaatgataacttaggcaatgaatcttgccagaactctgtaggtgagtcctataatatgaaagaagtggggaattatggtccaactccaagtgaaagaaaaaatgacgtgcatgaaaatgatgtttgtggttcgtcttctggatcagtagaggtacctgctactgctactagtgatgacttctgggattcattggaaatatcggatgaatctcttgatggtgaagttggcaaaagattaaaccagatggttcccattcctcatgttcctaaaaccaatgaaaaaataccatctgatgacgaagaaatatcagatcatcaaagacttctagacagattgcagttatatgatctgattgaatgcaaggttcaaggagatggtaactgccagtttcgttctttatcagatcaactctatcgttctccggaccaccacaaatttgtgcgggagcaaattattcaacagctcaaatattacccagatctgtatgctggttatgttcccttggcgtatagtgactatttgagaaatatgagcaaaagtggcgaatggggtgatcatgtcacattgcaggctgctgcagattggtatggcgtcaaaatttttgttattacgtcttttaaggatacatgttacatcgagattcttccacagatacagaagtctgaaagagtgatatttctgagcttttgggcagaggtgcattacaactcaatttatccagaaggaggtaacatttttatcttttataagctcttaaactgtagacggttacaattaatgtattcccacacccagttttga

SEQ ID NO: 4337 - DNA, 1317 bp, Glycine Max
atggcaatggcaattgcaatggttcctcaacctctgctgacccttttcctctttttctcccttctctcaattgccaactcttctccttcccaacaccttcagatcgccaatgccgaacgcaggattgatttgacttctcacattattaaggtgtacttgacattgaaggttgaaaatttggggacatctcctgcttcagaagtacatattgccttttcgcccactgaagtagaacatctagcaatagtcaaagctgctgcaacttctgggaagaggaagaagaaaacttatgttcctctagatgtcaaatctgctgagctacctgatggaccaaatggaactaagtttttctctataactttgttaactccactaagtaaaggtgaaaccacaacactagaggtgctttacatattgacacattctctggaacctttcccagtagaaataagtcaatcagagtcacagttggtttatttccgtgatagtgcaatattattgtctccctatcatgtcaagcaacagacaacttttattaagactccaagcacccgggtagaatcattcacagtggtggaccccactaaacgtgctggtacagagttgaaatacgggccatatgaaaatcatcccccgtattcatattctcctgtacttattcattttgaaaataacaatgcatttgctgttgttgaggagctagaacgtgaaattgaaatatctcactggggaagcattcaagtcactgagcaatatagcttggtccatgctggtgctcgacataaaggtgttttttcaagggttgaatatcaaactaaaccaggtggtactggtgtttcttcatttaaacatcttttagcgaaactaccccctagggttcactcagtatactacagggatggaataggaaatatttcctcttcacatctacgtacagattcttggaagtcagaacttgaaattgaacctcggtatcctctatttggaggctggaaatcaacctttgtcattggttatgggctaccattgcaagacttcctttttgagtctccggatggcagaagatacctcaattttacttttggttgccctcttgtcgagacagtggttgacaagttgattgtaaaagttgtgctgccagagggatccaaagatcccacagttgagattccttttgaagtgaagcaacatctagagatcaagtattcatatcttgatgttgtcggcagaactgtggtggttctagaaaaaagaaatgcagttcctgagcataatgctccttttcaggtatttaccaagcccaatgtgaaaaaataa

SEQ ID NO: 4338 - DNA, 1410 bp, Glycine Max
atggcaatggcaattgcaatggttcctcaacctctgctgacccttttcctctttttctcccttctctcaattgccaactcttctccttcccaacaccttcagatcgccaatgccgaacgcaggattgatttgacttctcacattattaaggtgtacttgacattgaaggttgaaaatttggggacatctcctgcttcagaagtacatattgccttttcgcccactgaagtagaacatctagcaatagtcaaagctgctgcaacttctgggaagaggaagaagaaaacttatgttcctctagatgtcaaatctgctgagctacctgatggaccaaatggaactaagtttttctctataactttgttaactccactaagtaaaggtgaaaccacaacactagaggtgctttacatattgacacattctctggaacctttcccagtagaaataagtcaatcagagtcacagttggtttatttccgtgatagtgcaatattattgtctccctatcatgtcaagcaacagacaacttttattaagactccaagcacccgggtagaatcattcacagtggtggaccccactaaacgtgctggtacagagttgaaatacgggccatatgaaaatcatcccccgtattcatattctcctgtacttattcattttgaaaataacaatgcatttgctgttgttgaggagctagaacgtgaaattgaaatatctcactggggaagcattcaagtcactgagcaatatagcttggtccatgctggtgctcgacataaaggtgttttttcaagggttgaatatcaaactaaaccaggtggtactggtgtttcttcatttaaacatcttttagcgaaactaccccctagggttcactcagtatactacagggatggaataggaaatatttcctcttcacatctacgtacagattcttggaagtcagaacttgaaattgaacctcggtatcctctatttggaggctggaaatcaacctttgtcattggttatgggctaccattgcaagacttcctttttgagtctccggatggcagaagatacctcaattttacttttggttgccctcttgtcgagacagtggttgacaagttgattgtaaaagttgtgctgccagagggatccaaagatcccacagttgagattccttttgaagtgaagcaacatctagagatcaagtattcatatcttgatgttgtcggcagaactgtggtggttctagaaaaaagaaatgcagttcctgagcataatgctccttttcaggtgtactacagttttaaccccatattcatgcttgctgagccattgatgctggtatctgcatttttcttgttttttgtggcttctgtggcatatcttcacattgatctttccatacgcaagtga

SEQ ID NO: 4339 - DNA, 168 bp, Glycine Max
atggcaccaatcaccacctattttttgattctcatgtcctcagtgttctatgttttctgggatgcacgtgtcgcgcttgaagagttcactgtccatgaccatcttggctttccaatgtcttcattgagttactccctcaaccaccatgaatatccaatccttctatga

SEQ ID NO: 4340 - DNA, 3513 bp, Glycine Max
atggcagaaaagaagaacccagaacaagaagaacaacaccgattcccagttctgacagtgctcaagaacaacgcaatcctcaagaacatcttcatcgtactcgatgaacacgacgaggatcagacggttctgattggacgacaccctaactgcaacatcgtcctcacgcaccccagcgtgagccgcttccacctcaggattcgctccaacccctcttcccgcactctttcactcgttgatttggcttctgtgcagggtacgtgggtgcgtgggaggaagctcgagccaggagtgagtgtagaattgaaggaaggtgacaccttcactgttgggatttccactaggatttatcgtctcagctgggctcctcttacccaattgggtgtcgttgtgccccaacaacatcaaaaagaagatgaacaagaaaacataatcaaggatgagaatttggaacacactgcagaacaagatattccgatgaagatccattctgaagatgaggcattgggagtacccaatggaactgaaacatcatgttttcctacaaactcttgtgttgaaaacataatttgtgactgtcaattatcacccccatacatacaatcacccccttgtgcacaaccggttgatgagcttgataacaccaagaaaattgaagctcgtctcgaagtggagatgcctggagaaactaatttgctttgcacattgagggaatatttgaaacacaacatatgtctgccagttgtggaagcagtccaggggaccaagatgcagcaatttcaagccccacatgatacttttaccggacaaccaccttccttggaaatgcattggtccagctttcaaataaatattgatccttcgtcttttgatgaaaaacatgctgctgcagtgcctgtaatacctacagaatctgaatttggatgcacacatggagatattgacaaggttgaagttgacgaagatatccctgattctgaatttcataaaatggaagttgttgaagaagtttctgtggattcagtacctgatggagaaaaacaagatgaaatgcatgggtcaagctcacctacaaatcttgatcccgcgtttttagatgaaaaacatgttgctgcaaacacatgcttgatagttgacaaagatattcctgattctgaatttcatcaaatggaagttgttgaagaaatatctgtggattcagtacctgatgaagaaaaacaagatgaatgcgatgaagagaacctgaatggtaaatcttgccgtgaggaagggtactctctagatgaagtagttgaagataatggaaacaaatgcattaaaaacatagatcctgcatcttttgatggaaagggcttgactgcagtaactgtaatacccacagaatttgaatttggatgcacactcggagataatgaaaggattgaagatattttagaaatggagtcaagaactatcaattctgagaacacatccttactggatgagaaagctattgctgttaccaaatttcaactagtcaatattgttgaggaagggggtaactataatgaaaggattgaagatattttagaaatggagtcaagaactatcaattctgagaacacatccttgctagatgagaatgctattgctgttaccaaatttcaagtagtcaatattgttgaagaagttgctatggattcaatatctgatggaaacaaatgcattaaaaacatagatcctgcatcttttgatggaaagggcttggctgcagtaactgtaataccctcagaatctgaatttggatgcacactcggagataatgaaaggattgaagatattttagaaatggagtcaagaactatcaattctgaaaacacatccttgctagatgagaatgctattattgctgttaccaaatttcaagtagtcaatattgttgaagaagttgctatggattcaatatctgatggagaaaaagaagataaatgtgggaaggagttggagtcaaagttgccggcttccctgaatgcgaagtcctgtcacgaacaaggtaagtctgtggctgaaatagctgaagatactggaaaaaaatgtgcaagcagcatctcctccacatcatttcaagtagaatcaccaaattcttcgatgcctcgggaacagacccctcaatctctcactgctgtgacaagatgctctggaggggagttccttgaaaaccatgtcaaaccaacagagaaaagctcagcctttggcagtatctggtcaaggtgtaagcctgctagtgctcccctagttcaagccagaaagagtagatttatgagcacagctaaggttggcactgaagttaaaaggagtaatgagaagaatgttgtcataaataaattaatgccgaaggatctttctgctgtttttgatgaggagaaagaagcattcattctaaataaggaaaatttaagcccaaatacctatcacttgcagtttatgagaaagaaagataagccagaagaaattaaacattccatatcacaaaggtcacccaatttgagctattttagtcccaggatctatttagacaaaagaataagcagtgtttcaaacaaagtgaaccagactccaaaagtagctcaagaatggaagtcacaaagaaagcctcttcaatgtcatatcaacttggtccatgagcaagatatgatggagttaaaaaagaacagagtggaaaaggtagcatccttcccatcactaatgaactcaggagggaaccataaatcagtgactgtttctgctgcaaaaagcattgatgatgtgcctatttgtggacagatttcaaataagtgcactaaaacttctcagcatactagtagagaacaaaagaggagctgggacatggttgtagacactgcttctcttctgaacaaggagtcaaggaaagctttgcagcttctacaaggcctcaaggggactcgtttaatcattccaagtttggtcataagggaactcggcagcatgaagcaaaaatttagaattttcagaacaacttcagaggcttctttggcattagagtggattgaagaatgcttggagaaaacaaggtggtggattcatatccaaagctcaatggaggagttcaggctgacagctctaacccatcatgcttctcctcagactcggtttattgaagagagttgggcttttcctggtttgaataccttgaagaaatgtgcttcacctaaagttgaagatcacatccttgactctgcccttcaatatggaagaaaggagaatgttggacaacttgtccttcttagtagtgatgtctcattgaaaataaaatccatggcaaaggggttgctatgtgagacagtgcaacaatttcggcagagtttagtgaaccccttctctgagaggttcatgtggccaaagagctctcctcgaggactgacttggtcttgccaagatgatttagttttaagggagaaatattgtggattgccatcaaaagctggtttgaagctcattactttccatgattag

SEQ ID NO: 4341 - DNA, 3510 bp, Glycine Max
atggcagaaaagaagaacccagaacaagaagaacaacaccgattcccagttctgacagtgctcaagaacaacgcaatcctcaagaacatcttcatcgtactcgatgaacacgacgaggatcagacggttctgattggacgacaccctaactgcaacatcgtcctcacgcaccccagcgtgagccgcttccacctcaggattcgctccaacccctcttcccgcactctttcactcgttgatttggcttctgtgcagggtacgtgggtgcgtgggaggaagctcgagccaggagtgagtgtagaattgaaggaaggtgacaccttcactgttgggatttccactaggatttatcgtctcagctgggctcctcttacccaattgggtgtcgttgtgccccaacaacatcaaaaagaagatgaacaagaaaacataatcaaggatgagaatttggaacacactgcagaacaagatattccgatgaagatccattctgaagatgaggcattgggagtacccaatggaactgaaacatcatgttttcctacaaactcttgtgttgaaaacataatttgtgactgtcaattatcacccccatacatacaatcacccccttgtgcacaaccggttgatgagcttgataacaccaagaaaattgaagctcgtctcgaagtggagatgcctggagaaactaatttgctttgcacattgagggaatatttgaaacacaacatatgtctgccagttgtggaagcagtccaggggaccaagatgcagcaatttcaagccccacatgatacttttaccggacaaccaccttccttggaaatgcattggtccagctttcaaataaatattgatccttcgtcttttgatgaaaaacatgctgctgcagtgcctgtaatacctacagaatctgaatttggatgcacacatggagatattgacaaggttgaagttgacgaagatatccctgattctgaatttcataaaatggaagttgttgaagaagtttctgtggattcagtacctgatggagaaaaacaagatgaaatgcatgggtcaagctcacctacaaatcttgatcccgcgtttttagatgaaaaacatgttgctgcaaacacatgcttgatagttgacaaagatattcctgattctgaatttcatcaaatggaagttgttgaagaaatatctgtggattcagtacctgatgaagaaaaacaagatgaatgcgatgaagagaacctgaatggtaaatcttgccgtgaggaagggtactctctagatgaagtagttgaagataatggaaacaaatgcattaaaaacatagatcctgcatcttttgatggaaagggcttgactgcagtaactgtaatacccacagaatttgaatttggatgcacactcggagataatgaaaggattgaagatattttagaaatggagtcaagaactatcaattctgagaacacatccttactggatgagaaagctattgctgttaccaaatttcaactagtcaatattgttgaggaagggggtaactataatgaaaggattgaagatattttagaaatggagtcaagaactatcaattctgagaacacatccttgctagatgagaatgctattgctgttaccaaatttcaagtagtcaatattgttgaagaagttgctatggattcaatatctgatggaaacaaatgcattaaaaacatagatcctgcatcttttgatggaaagggcttggctgcagtaactgtaataccctcagaatctgaatttggatgcacactcggagataatgaaaggattgaagatattttagaaatggagtcaagaactatcaattctgaaaacacatccttgctagatgagaatgctattattgctgttaccaaatttcaagtagtcaatattgttgaagaagttgctatggattcaatatctgatggagaaaaagaagataaatgtgggaaggagttggagtcaaagttgccggcttccctgaatgcgaagtcctgtcacgaacaaggtaagtctgtggctgaaatagctgaagatactggaaaaaaatgtgcaagcagcatctcctccacatcatttcaagtagaatcaccaaattcttcgatgcctcgggaacagacccctcaatctctcactgctgtgacaagatgctctggaggggagttccttgaaaaccatgtcaaaccaacagagaaaagctcagcctttggcagtatctggtcaaggtgtaagcctgctagtgctcccctagttcaagccagaaagagtagatttatgagcacagctaaggttggcactgaagttaaaaggagtaatgagaagaatgttgtcataaataaattaatgccgaaggatctttctgctgtttttgatgaggagaaagaagcattcattctaaataaggaaaatttaagcccaaatacctatcacttgcagtttatgagaaagaaagataagccagaagaaattaaacattccatatcacaaaggtcacccaatttgagctattttagtcccaggatctatttagacaaaagaataagcagtgtttcaaacaaagtgaaccagactccaaaagtagctcaagaatggaagtcacaaagaaagcctcttcaatgtcatatcaacttggtccatgagcaagatatgatggagttaaaaaagaacagagtggaaaaggtagcatccttcccatcactaatgaactcaggagggaaccataaatcagtgactgtttctgctgcaaaaagcattgatgatgtgcctatttgtggacagatttcaaataagtgcactaaaacttctcatactagtagagaacaaaagaggagctgggacatggttgtagacactgcttctcttctgaacaaggagtcaaggaaagctttgcagcttctacaaggcctcaaggggactcgtttaatcattccaagtttggtcataagggaactcggcagcatgaagcaaaaatttagaattttcagaacaacttcagaggcttctttggcattagagtggattgaagaatgcttggagaaaacaaggtggtggattcatatccaaagctcaatggaggagttcaggctgacagctctaacccatcatgcttctcctcagactcggtttattgaagagagttgggcttttcctggtttgaataccttgaagaaatgtgcttcacctaaagttgaagatcacatccttgactctgcccttcaatatggaagaaaggagaatgttggacaacttgtccttcttagtagtgatgtctcattgaaaataaaatccatggcaaaggggttgctatgtgagacagtgcaacaatttcggcagagtttagtgaaccccttctctgagaggttcatgtggccaaagagctctcctcgaggactgacttggtcttgccaagatgatttagttttaagggagaaatattgtggattgccatcaaaagctggtttgaagctcattactttccatgattag

SEQ ID NO: 4342 - DNA, 1836 bp, Glycine Max
atggcagcaacaacatcagggaagattatccaaaatgtttttgtttcacactgccaccaacagaatacacggggtcgaagggactattattgttttggcccttctccgctggggaagttggcatggactgactcttccatgcaattgcgcactttattcaaaccccagaatcattttagtttccagagaaattttcacagcaatgcttctgcatctgctactgctgtgccatatctagacaagacagattttctaaagcttcaaaatggcagtgacattcgtggtgtggctgttgatggtgttgagggagagctagttaacctcactgaacctgttgctgaagcaataggagctgcttttgctgcatggttaatggagaaaaagaaagctgatgcttctcagcatttgagagtttctattggccatgattcccgaatatcagccaaattattacagaatgcaatttctcgaggtcttgctggtgctggcctagaagttgtccactatggattagcatcaacaccagccatgttcaatagcacactcacgaagaatgaagcatttttgtgtcctgctgatggatctattatgataacagcaagtcatctgcctttcaacaggaatggattcaaatttttcacaaatgctggtgggtttgggaaggccgacattaaagatatcttagagcgagctgcagacatatacaatcaatttacagaagaaagtttgccaaattcagagagaaaagcttcactatctattaagaaagttgattacatgattgtttatacatctgatttagtaaaagcagttcgcaaggcagctggaaacataggcatgactttgttgaattcttccctttactttgttgatgcaggcaatggagcaggaggcttttttgcagcaaaggttctggaacctctgggggcaataacttctgggagtcaatttttggagcctgatggcttgtttccaaatcatatcccaaatcctgaggacaaaacagcaatgaaagctataacccaagcagtccttgataacaaagctgatcttggaattatctttgatactgatgtggacagatctgctgctgtggatttcactggccgtgaattcaacaggaatcgtttaattgccttaatggcagctattgttcttgaggaacatcctggaacaactattgtcacagacagtgtgacttctgatgggcttaccacgtttattgagaagaaacttggtggaagacaccatcggttcaaaagaggttacaaaaatgtgattgatgaagctattcgtttgaattctattggcgaggagtcacatttggcaattgaaactagtggacatggagctctcaaggaaaatcattggcttgatgatggtgcatacctaatggtcaagatcttaaataaacttgcttctgcaagagcttctggaaagggtggtggaagcaaggttttgactgatctaatagacggacttcaggagccagcttttgctgcagaactgagattaaagataaaccaaaaccatccagatcttaaaggaggatcttttcgggaatatggagaagctgtgctgaaacatttggagaattcaattggctctgatccaagtctgctcaaggctcctgtgaactatgaaggggtccgagtttctggctatggtggatggttccttcttagattatcactccatgatcctgtacttccccttaacattgaggcacctagtaatgacgatgctgtgaagcttggacttgctgtgcttgcagctgtaaaggacttcgcaggtttagacacatcagccttgaacaagttggtaggagcatcataa

SEQ ID NO: 4343 - DNA, 1635 bp, Glycine Max
atggcagcttctgcatctgctactgctgtgccatatctagacaagacagattttctaaagcttcaaaatggcagtgacattcgtggtgtggctgttgatggtgttgagggagagctagttaacctcactgaacctgttgctgaagcaataggagctgcttttgctgcatggttaatggagaaaaagaaagctgatgcttctcagcatttgagagtttctattggccatgattcccgaatatcagccaaattattacagaatgcaatttctcgaggtcttgctggtgctggcctagaagttgtccactatggattagcatcaacaccagccatgttcaatagcacactcacgaagaatgaagcatttttgtgtcctgctgatggatctattatgataacagcaagtcatctgcctttcaacaggaatggattcaaatttttcacaaatgctggtgggtttgggaaggccgacattaaagatatcttagagcgagctgcagacatatacaatcaatttacagaagaaagtttgccaaattcagagagaaaagcttcactatctattaagaaagttgattacatgattgtttatacatctgatttagtaaaagcagttcgcaaggcagctggaaacatagagaaaccattggagggtttccatatagttgttgatgcaggcaatggagcaggaggcttttttgcagcaaaggttctggaacctctgggggcaataacttctgggagtcaatttttggagcctgatggcttgtttccaaatcatatcccaaatcctgaggacaaaacagcaatgaaagctataacccaagcagtccttgataacaaagctgatcttggaattatctttgatactgatgtggacagatctgctgctgtggatttcactggccgtgaattcaacaggaatcgtttaattgccttaatggcagctattgttcttgaggaacatcctggaacaactattgtcacagacagtgtgacttctgatgggcttaccacgtttattgagaagaaacttggtggaagacaccatcggttcaaaagaggttacaaaaatgtgattgatgaagctattcgtttgaattctattggcgaggagtcacatttggcaattgaaactagtggacatggagctctcaaggaaaatcattggcttgatgatggtgcatacctaatggtcaagatcttaaataaacttgcttctgcaagagcttctggaaagggtggtggaagcaaggttttgactgatctaatagacggacttcaggagccagcttttgctgcagaactgagattaaagataaaccaaaaccatccagatcttaaaggaggatcttttcgggaatatggagaagctgtgctgaaacatttggagaattcaattggctctgatccaagtctgctcaaggctcctgtgaactatgaaggggtccgagtttctggctatggtggatggttccttcttagattatcactccatgatcctgtacttccccttaacattgaggcacctagtaatgacgatgctgtgaagcttggacttgctgtgcttgcagctgtaaaggacttcgcaggtttagacacatcagccttgaacaagttggtaggagcatcataa

SEQ ID NO: 4344 - DNA, 183 bp, Glycine Max
atggcatcactcaaagctgagatacctgttgagaaatcttgttgctctcaaccatctgcaggacaggtgaagaaagagtcttctgccaaacctagttcaggcacttccaaagccacagcctccaaaccaaccccaaagaaaactccaagccagaataggaagaaggcaagcagcaataaataa

SEQ ID NO: 4345 - DNA, 204 bp, Glycine Max
atggcatccctcaaggctgacaaacccgttggcactcaactttttgggcagggtaaaaaggaagctgctcccaaagctagtgatggtgcatcatccaaatccaagggttcagcttccaaatctgctaccaagaaagttccagtacagaagccccaagaatccaagaaaaagggaaaaggaggcaaatcatctacaaagcactag

SEQ ID NO: 4346 - DNA, 1215 bp, Glycine Max
atggcatgtcgctctgttctttcatcttctcctcacataacgaactccatggccatcaaggagggtgtcctctccttcgcacccaaccctcctctgcttcttcgtctcccgaaagccgttacctttctctccttttctgcttccactaaaccccccactaagtcttttcaagtgagatcagttgctggtactacagaagctgcatcggggtttgatgagatgatttctgggactaagaggaagtattacatgcttggtgggaaagggggagtagggaagacaagttgtgctgcttcgcttgctgttaaatttgccaataatggacaccccactctcgtggtttccaccgatccagcgcattctttgagtgattcttttgctcaggatttgactgggggtgcattggtgccagtggaaggacctgattatccactttttgctcttgaaattaaccctgagaagtttagggaagagtttcaaaatgccgcccagaaaaagggtggaaccggagtcaaagacttcatggatggcatgggccttggaatgattgcagatcagttgggagaactaaaactgggagaattactggattcacctcctcctggactggatgaagctattgcgatctccaaggttatacaatttctcgaatcacaggaatatagcatgtttactcgaatagtatttgatacagcacctacgggtcacacattacgattattgtccttacccgatttcttggatgcatccattgggaagatactgaagctaagacaaaagatagcttctgctacctcagcaattaaatccgtatttgggcaagaagaaacccgacagaatgctgctgataaattggagaaactcagggagaggatgataaaagtgcgtgaactctttcgtgatactgattcaaccgaatttgtcattgttacaatccccacggtgatggcagttagtgaatcatctagattgagtgcttccttgaagaaggaaaatgttcctgtgaagagacttattgtcaaccagattcttccaccgtctacatctgattgcaagttttgtgctatgaaaagaaaggatcaaatgcgtgctcttgatatagttcagaatgatccagaactctccagtttatcaatgatccaggcaccactcgtagatgttgagataagaggtgttccagctctcaaatttcttggtgacattatttggaaatga

SEQ ID NO: 4347 - DNA, 1215 bp, Glycine Max; identical to SEQ ID NO: 4346

SEQ ID NO: 4348 - DNA, 3318 bp, Glycine Max
atggcattgattgctttgaaaaagggtgctcaactacttaaatatggtcgtaagggaaaacctaagttttgtccgtttagactttccaatgatgaattgtctttaatctggatatccagtagtggagaaagaaatctgaagctatcttctgtctcaagaattattcctggacaaagaactgctgttttccaacgatatctgtgtcctgagaaggactatctatctttttcacttatttataacaacgggaagcgatcccttgatttgatttgcaaggataaagttgaggcagaagtgtggattgctggtctcaaggcactgatatcttccggtcaaggtgggcgttccaaaattgatggatggagtgatggaggcctatatcttgatgacagtagagacttgacatcaaatagtcctagtgaaagttcagctagtgtttcacgtgacatcagttctcctgacgtttctgttagtctggcaaatacttctccacaatccttttactttgagagtaccttaaatattgaaaggtcacatgcaccatcaaacccatcaaatatgcaagtgaaaggatctagttcagatgtttttcgtgttagtgtctcaagtgcccccagcacatccagtcatgggtctgcacccgatgattatgatgctcttggggatgtatacatatggggggaggttatctgtgagaatgttgtgaaagttggtgctgagaaaagtgctagttattttagcccaaggacagatattctcctccccaggccactggagtccaatgtggttttagatgtgcttcaaatagcatgtggtgttaaacatgctgctcttgtcacaaggcaaggtgaactttttacatggggtgaagagtctggaggacgccttggccatggtgttgggaagaatgtgattcaacctcgtctagttgaagcaatggcttccacaactgttgattttgttgcctgtggggagttccatacctgtgctgttacaatggctggggaactatatacatggggtgatggtactcataatgccgggcttcttggtcatggcactgatgttagtcattggataccgaagagaattgcaggtccactagaggggcttcaagttgctttagtcacttgtggtccgtggcacacagccttgataacttcaactgggcagctcttcacatttggtgatggaacatttggtgtcctaggccatggagatagggaaaatgtttcatatcctagagaagtagaatccttatctgggttgaggacaatagctgttgcttgtggagtttggcatactgcagctgttgtagaggttattgtgacacaatcaagtgctagtgtatcatcagataaattgtttacatggggcgatggagataaaaatcgccttggacacggagacaaggatgcccggcttgaaccaacttgtgtatctttacttattgattccaattttcatagaattgcttgcgggcacagtttgacagtaggcctgacaacatccggagaagtttttacaatgggaagctctgtttatggtcagcttgggaatccccagtccgatggaaaggtgccatgtttggttaaagacaagcttgcaggagaatccgttgaagaaattgcatgtggggcttatcatgttgctgttttaacttccaaaaatgaagtttacacttgggggaagggtgcaaatgggagattgggtcatggagatgttgaagatcgaaaaacaccgactttagttgaagccttgaaagatagacatgtgaaatatatcgcatgtggttcgaactactctgccgccatatgccttcataagtgggtatccggtgctgagcagtctcagtgctctgcttgtagacaggcatttgggttcactagaaagagacacaactgttataattgtggactcgtgcactgtcattcatgtagttctaggaaagcattaagagcttcccttgctcctaatcctgggaagccctatcgtgtttgtgattcttgtttcgtaaaattaatcaaggttgcagaatcgggcaataataatcggaggaatgctatgcctcgtttgtcaggtgaaaacaaggacagattagagaagtctgagctaagattgaccaagacagcagtcccttctaatatggatttgataaagcagcttgatagtaaggcagcagccaaacaggggaagaaggctgatacattctctctggttcgcacctcacaaccacaatctttgctacagctcaaagatgttgtcttgtctactgctattgatttgaagcgaacagctccaagacctgttctgacaccatctggagtgagttccaggtctgtatcccctttctctagaagaccaagcccgcctcgttcagctacacctattccaacaacatcgggactttccttctctaaaagtattactgatagtttgaagaaaacaaacgaacttttgaatcaggaagtgttgaagttacgcggtcaggttgagaccctgagacagagatgtgaactgcaagaattggagcttcaaaggtcaacaaaaaagactcaggaagctatggcactggctgccgaggaatctgccaaatctaaggctgcaaaggaagttataaagtcacttacagcacagctcaaagatctggctgagaggcttcctcccggtgcttatgatgctgaaaacatcagaccagcttacctgccaaatggtctggagccaaatggcatccactatccagaattaaacggtgaacgtcacaccagggcagagtccatcagtggctctagtttggcttccataggacttgaatcatccctattgaatagaaccgagggcactttgcctggaagctatggagctaatctttacctgcaaaaccggggatctgtaacctctaatgggacagatgattacccgaatgttaaattgccaaatggcagcagcatgattcagccaagcagcagtactgtgtcagatatggttgatggtagggattctggagatttccaagatgatgagagtggtttgagatcaagaaacaccatagtgcctgctaatagtaatcaagttgaggcagaatggattgaacaatatgaacctggtgtctacattacactggtcgccttgggtgatggaacaagagatctgaagcgagtgcgattcagccggcgaagatttggagagcaccaagcagagacttggtggtcggagaaccgcgatagggtatacgaaaggtacaatgttcgaagcacggacaagtcttccggccaagcggcacgtaggacagagggtgctggttcacctgttttataa

SEQ ID NO: 4349 - DNA, 915 bp, Glycine Max
atggccaaaagcaaaaactgtcatgctttgcctcttctccttgccctgatcctcttcttcactcttcttggaacctctcacgcaggtggcatagccatctactgggggcaaaatggtaacgagggcaccctctcagaagcatgtgcaacaggcaaatacacccacataaacatagcctttctcaacaaattcggcaatggccaaaccccagaaatgaacctggctggtcactgcaaccccgcaaccaattcctgcacaaagttcagctccgaaatcaaggactgccaaagcaaagggatcaaggtgttactttcaataggtggtggcattggaagctacactttggcttcagtagaagatgcaagaaacgtttcaacttttctgtggaacactttcttgggaggcaagtcatcatcatcttcaaggccactaggtgatgctgtgttggatggcatagactttgacattgaacttggttcaacacaaaactatgagcaccttgcacgttttcttaaggcgtatagtggggttggcgggaagagggtgtacctaggtgctgctcctcagtgtccaattcctgatagatttttgggcactgcccttaacactggcctttttgactttgtttgggttcagttctacaataaccctccgtgtcagtatgctaatgggaacataactaaccttgtgagttcttggaaccggtggactagtacggtgcctgccgggaagatatttttagggttgccggccgatccggccgctgctggcagcggtttcattccggctgacacgttgacttctgagatcctgcctgtgattaaggagtcgccaaaatatggtggggtgatgctgtggtcaagattctttgatgtccagaacgggtatagtacttcaattattggcagcgtgtga

SEQ ID NO: 4350 - DNA, 285 bp, Glycine Max
atggccaattctcattattctaaaactttgcatcttccatgcaaatccttctctatggctattctccttgtttacttgcttcttgttggttcttgcactgcaataaggacaggcgcaaccatgcggttgaatgaaggctcagaacttctccggcggaagcagcaacaaccgcgatttccttacaaaggtcttgttttcaacttcttacccaaaggggtgccaattccaccttcaggcccttcaaagaggcacaactcagtggtggcttccacacctaagaattga

SEQ ID NO: 4351 - DNA, 546 bp, Glycine Max
atggccacagtaggaaggaacgttgcagctcctttgctgtttcttaacttgatcatgtattttattgttcttggctttgctagttggtgcctcaacaggttcatcaatggccaaacttaccaccctagttttggtggaaatggtgcaaccatgtttttcttaaccttctccatactagcagctgttctgggcatcgtgtccaaacttttgggtgggaatcacatgaggacatggaggagtgacagtttagcatctgcaggagccacatcaatggttgcttgggcagtcacagctctagcatttgggttggcttgcaagcaaatacacttaggagggcatagagggtggaggctgagggtagtggaggcattcataataatactaacattcacacagttgttgtacctgatactgatccacgcggggctatatagcagcagatatggtcccgggtaccatgacactgactatggtcatggacatggtgtgggagggactacaggagatccaatgcacaagcctgctactgcaggaactcgtgtctaa

SEQ ID NO: 4352 - DNA, 1638 bp, Glycine Max
atggccacctcccagtcccagcatcgctgcgttttcgttgggaatataccgtatgatgccacagaggaacagcttattgaaatctgccaggaggttggcccagtagtctcattcagactagttattgacagagaaactgggaaaccaaaaggttatggattctgtgagtataaggatgaagagacggctttaagtgctcgacgaaatcttcagggttatgaaattaatgggcggcaattacgcgttgattttgctgaaaatgataaagggaatgatagaaaccgagaacagggtcgtggcggtcctggaatgactacaaatgttgaccatcagaaacaagttggcatcccagctgtccttggggaagctgttcagcatcagcctattggtcttcatattgccataacagctgcagctgtcatgacagcagctctaggtggtgctcagtttggcatccagtcaaatcaaaatagtttgcagagtcagtcagcattagcacatgatcctttaactctgcatctggccaaaatgtccaggagtcagttgactgagattatctctgagctgaagggaatggctacacagaacaaggaactggctcgtcagctgttgctttcaaggccacagttgcccaaggctctttttcaggctcagataatgctaggaatggtgacttcccaagtgttacaaatgccgaaccttaggctggtttcagatcaaacctcacagtctttaatgaatgaaggccagctgggtcagccatcattggttcaaactctgtcaggccttcctcctcctgggcagggcaagttgcagcctggtttgacaccttatgctcaagaaggccaagtcaacaccatacctcataatcctttggctcctaatcaattaactgcacatccaaagcctccagtgcagcctcggattccccttcagcaacatccaaacaatcttgtactgccaggaacattgtcagggcagtctaatttaatgcttccttctgcacgtcctccaggtttgggcagtttgtctgttaggcctctaattcaaccgggaacttcaactgctctgaaccagcaaatgcatccctctttgctacagcattctgtacatgttggaaactcaactgtaggacataatattcaaatgcattgcccctccatgtcatcagcaaattctcagttactgagtaaaggtgataaatcttctaaagttattgaggatttaaattgggccaagagagctaatacacattcaaaatcaaacattcctttgggagtagagaaaacaaacatggttcatgattcttcagaatcttttactcggccgtcaaaggtcatgaaattggatgagggaaggagtgcccctctttcttcaggaatttcagacatgcctttcaccgatggatcatctcatatcctgggaagaagttcattacctgtacatgcagctcctaaagcggaagggcaatactctgagcaacaattttctcagcttccacctgatgtggagtctgttttgctgcaacaagtattgaatctgacaccagaacaattgagttccttgccaccagatcagcaacaacaggtcattcagctccagcaggctctacggcgagatcagatacagccctcataa

SEQ ID NO: 4353 - DNA, 642 bp, Glycine Max
atggccactgccactgtttcaatttcaacactatgcgctaccttcggaacccattgcgccatttcccacgaccctaaacctcttttttctcaacctttcagtctcaatcgctttccttctacctcttacaagctcactttatcgcctcgctcacctatttcaacccttcctaaggtctctgaatccgcggttgccgaaaccgaaaccggttcgtccgagcccgaaccggaccaaattgtcccggctcagcctccctcctgggaacccggtctcttcgctgtcgtaatgattggtggacgccaatatattgttcacccggggcgacatcttactgttcagaggttgaaaggtgctaatgttaatgataagattgccttacacaaggttttactggttggcactgatacatcttgctacattgggaaaccaattgtaacaaatgctgtagtatatgcaacagtggaagagcagggtctagaccccaaagtaattgtcttcaaatataaaaagaagaaacactatcgcagaaacattgggcacagacagccaaatacacgtatacggataaatagcattatgggctatgagaactacccaaaagttactatggacgacatcaaatcagacgaacccggatcatga

SEQ ID NO: 4354 - DNA, 333 bp, Glycine Max
atggccataaaaatttcccaagcagttcacattcttttgttgctctcccttctattgttagtttttcacgagtattacaatctcaagtccaagatcaacaagaagcagatcacacaaactagccactactcattattaccctctcatcaccattttatgagcagaaaatttctagcaaccaaatttgacttctctcctttcttcaggcatcatcataaacaccaccaaccgggtggggcagtgcaccatgatccttcagacacagagattgatccacgttatggcgttgagaagcgtcgcgtgccaactggtccaaacccattacaccattga

SEQ ID NO: 4355 - DNA, 1089 bp, Glycine Max
atggccataaagacaatggaactattgaaagggtgcggatcacaggaagagataatggaagtgctttctgcagtggcttcggatttgggggatgtgatcgatgatgtgaacaccttgcaggtgattccactgaatggtgcattgaccaatgaagtttttcagataaactggccaaccaaaaatgatggtgaggtcagaaaggttctgattcgtttatatggggaaggtgttgaagttttctttgacagggaagaagaaattcgaacctttgagtgcatttcaaagcatggtcagggtccacgccttcttggccgattcacctctggcagagttgaggagtttattcatgccagaactctatcagctgctgacctccgtgaccctgaagtatctgctttgatagcatctaagatgagagagttccataatcttcatatgcctggtgcaaagaaggctcagatttggcacagagtgaggaagtggcttggtcaagccaaaagtctgtgctccccaaaggatgcaaaaaaatttggcttggacaatctggatgaggaaataaatatcctggagaagaagttatctgaaggatatcaagagattgttttttgtcacaatgacttacaatatggtaacataatgatggatgaagagacaagattaatcactataattgactacgaatatgccggttataatcctattgcatatgacctggccaatcatttctgtgaaatggtggcagattaccacagtgacacacctcatgttcttgactacaagaaatatccaggactagaggaacgtcaaagatttattcgcaactatctgagttctgaaggcaataaaccaagcaatgctaaagtgaaccagttagtgaaagctgcagaaaaatacactcttgcaaaccatctattttggggtttgtggggacttatttcgagttatgtgaacaaaattgactttgactataaggagtatggaaggcagaggtttcagcaatactggataaggaagcctactttattggactcaccaagcatcgtttccctagatgaaactgtgaatggattgctgtcatccttcacgtga

SEQ ID NO: 4356 - DNA, 111 bp, Glycine Max
atggccgcggaagctttgaagggtagccaccttgatgaggtgaagcgcatggtggaggactaccgtaaccccgtggtgacgttgggtggcaagagcctcaccgtgtctcag

SEQ ID NO: 4357 - DNA, 909 bp, Glycine Max
atggccgctaccaccaacaaagacgaagccattagcaccagtgcatcttcttcttcttctccagtcttcatatccacagagaccctattcaccatccttacccatcacactctgatgaaccacctccaatccactctccccaaagcatcaaccattctccaaaccccaattcgccaacaccactctctctttccttcctcctccctcctcctcatgccttcatggtcctcttccccttctctcccttacatcggcgtcaaactcgttacccatttccctcaaaactcttctatcaacttacccggcgtgcagggaagctatgtcctcttcagttccaccaccggccaaaccctagcttccatgaactccaccgaactcaccctttacagaacctcatcgagacatgacagcgaggttcttgttatggtaggtgctagttccttggcaccgcgcctgatcaaagcccatctttcagccatacccagtttgagaaaagtcatcatctggaacagaacagtgggaaaggcgacaaatttggtcaaagtggggaatttggttgtcggatttggggacattgtgagttgcgccacgaattccgagacaccccttgtgaagggtgtgaggttgaagggtggggcgcatttggatttggtgggttccttcaagccttcgatgatggagtgtgatgatgaggccataaggaggggaaaggtttttgtggacaatgaggctgcattagttgaagcaggggagctggtgggtgcttttgagagaggggtcatcaagagagatgaaattggagggagtttggtggagcttgtgagaggtgacaaagttgggagaagcagttctgagcagattactgtgttcatgtctgttggttctgctgttacttacacaaggagctag

SEQ ID NO: 4358 - DNA, 1011 bp, Glycine Max
atggccggcaaccccgccaccacttcctcctccgcattatctcccgagaaatttaatttcaatttctcccccgataacccctcccgaatcaccctcacttcggatcaggtcaaccactgcacccaagccctcaacattctgaaggagaagctccacgctcctaacgtgatcactcaggagttcgcacacttgcaggcgaacaggataacgccgagcgagatgaggagaagatgcaccgtcgcgtatgacgacgtcaatttgaggaaaaaccgatacaccgacgttctgccatttgacaagaacagggttgttctcaaatctagtactgattatagacctgaagcacaggggtatatcaatgcaagccttgtctcgacctcctcagctggaaacgtgtcccagtttatagccacgcaaggtccacttcaacatacttacgaggatttctgggaaatgatcatccaatatcactgccctgcaattatcatgcttactaggttggtggataattacaagatgacaaaatgtggagattattttcaagctgaggataggcctagagaagttggtaatatttctattattggtaaatgggagaacactactgaaacttcactcgtgctgcgccatttggaggtgaaccatagagaggtagaagatgcgccattatctgttttgcatattcagtatcctgaatggcctgaccatggagttcccaaagatacatttgctgtgcgtgaaattctgaaaagattataccatttaccaccaaactttggtccaatagtggtgcactgcagtgcaggtattggtagaactggaacatactgcacaattcacaacacaattcagagaatagttgctggtgatatgtctgctgtagatattgctaagacaatagctatgttcaggtcccagcgtattggaatggttcagacccaggatcagtacattttctgctataacgctatcatagatgaactggaagaccttgtatctcagcagcagtag

SEQ ID NO: 4359 - DNA, 234 bp, Glycine Max
atggcgaaagtggctaaaccaagttctgtgccctcgagctctcaccaacttggctccggacctttgaaaactggatctatggctagaaagaagacaccgtcagaacttaggactcggcgattaaggtcattctatgatgttgataatagcccagaatctttgctggcttttagtggcaacaacaatgtacatgctttatatgactttttactaaattacaggttttttaattga

SEQ ID NO: 4360 - DNA, 864 bp, Glycine Max
atggcgaaggacgttgaggttgctgagcgtggctccttctctgggaaggactaccaggaccctccaccagcaccactcattgatgctgaggagctcacaaagtggtccttttacagggctctcattgctgaattcattgccactttgctcttcctctacattactgtgctcacagtcatagggtacaatcaccagactgacctcaaggaaaatggtgaaatctgtggtggggttggcattcttggcattgcatgggcctttggtggcatgatcttcatccttgtctactgcactgctgggatttcagggggtcacattaacccagcggtgacatttgggctgtttttggctcgcaaggtgtctttgatccgagccatcatgtacatggtggctcagtgcttaggtgctatctgtggagttggtttggttaaggctttccaaaagtcttacttcaacaagtatggtggtggggctaattccctcgctgctgggtacagcacaggtactggattgggtgctgagattattggaacctttgttttggtctacactgtcttctctgccactgaccccaagaggaatgccagagattcccatgtgccggttttggctccacttcccattggatttgctgtgttcatggttcacttggccaccatcccagtcactggtactggtatcaaccctgctaggagtcttggagctgctgttatctacaaccaagataagccatgggatgaccattggatcttttgggtaggaccatttattggggcagccattgcagccttctaccatcagttcatcttaagagcaggtgcagctaaggctcttggatcattcaggagtaacccccataattga

SEQ ID NO: 4361 - DNA, 2478 bp, Glycine Max
atggcgacggtgctagcaccgccaccgtcgctcaccgtgcgcgcctcctcgtgccgccggcatagcaagaagaagcagcagcagaagcgagcattgggagacttcagcctcttcgcacaagtggttcgcaaggacgtggaattcctcaagagaggaatcgataacggtgttgcctgggccaaggagaccttccgcattcccgaggttgccaagaaaatcgacgacgttgtttggctccgcaatctcgaagaccctacctctcctcctcttccttctccttcctggccccaaccttgttacccagggctaactggagtggatttgctcatgtatgatctcaaggcttttgaagcttatgcttcttacttctactatttctctaagctttggaccaggccgctccctcaagattatgatcctcagcaagttgctcagtattttagtgttcggccccatctggtcacccttcgtgttcttgaggtacttttctcctttgccactgctatgatcagtattcgaacttcaggatttagcaagtttctacggctaattcctgaagaggatgtggatgatacatcatctcagtataattttggaatggtgttaaaggaaacattgcttaatcttggccctacctttataaaagttggtcagtccctttccacaaggccagatatcattggtgttgagatgtccaaggcattgtcagaattgcatgatcaaatccctccttttcccaggactgttgctatgaagattatggaggaagaatttggttgtcctctggaatcattctttagttacatttctgaggaacctatagctgctgcatcctttggtcaggtttactttgcccgtactactgatggtaataatgttgctgttaaagttcagcgtcctaatttgcatcatgtggtggttcgggatatctacatccttcgccttgggttggggctgctgcaaaagattgccaagagaaagagtgaccctcgcctatatgctgatgaactagggaaaggttttgttggtgaattggattacactttagaggctgcaaatgcttcaaagtttctggaagttcactcttcctttacttttatgaatgtgccaaaagtatttccacatttaactcgaaagagagttctgaccatggagtggatggttggtgaaagtccaacagatttgctctctgtgactgctggaaactctgttggaaatgtctctgaatattcagaaaggcagaaattagatgcaaaaaggcgtcttcttgatctggtcagcaaaggcattgaatcaacattggtgcaacttcttgaaacaggcttattacatgctgatccacatcctggtaacttgcgttacacttcctcaggacaaatagggtttctggattttggtttgctctgtcaaatggaaaaaaggcatcagcttgctatgctggcttcaattattcatatagtaaatggtgactgggcatcccttgtccgtgctctggttgatatggatgttgtgaggccagggacaaatatcagacttgttaccctggaactggaacaagccttgggagaagtagaatttaaagaaggaattcctgatgtgaagtttagcagggttctgggaaagatttggactgtagcactcaagcatcatttccgcatgccaccatattatacacttgtcttgcgatccctagcttcattggaaggtttggctattgctgcagatacaaatttcaagacttttgaagctgcatatccttatgttgttcggaaacttctcacagagaactcagctgcaacaaggaatatattgcattcggtgcttctaaaccaaaggaaggagttccagtggcaaagactttccctgttcttgagggtaggggcaaccaggaaagccttgcgactagtggcatcaaatagtgagacttcccttgatcattcaacaagtaaggccactgatacaattgatattgcatatttggttttgaggcttttaccatccaaagatggtgttgctatcagaagacttctcatgactgctgatggagcttcattaatcaaagcaatggtctcgaaggagggggagtttttccgtgaacaactctgcaagatcatagttggcatactgtaccaatggatgattaaattatttggacaaggaattacaattactcagtattcccggatggtattggctaacggacctagcagcaaagaatcaggtctatcccctagatcatctttgcctacatatgattacaattccatctttagagatcggcgacttcgggtgatattctctaaggttctaaaatctgcaagtagggataaaatattgatgctgcggttctcctgggcttcccttaaaataattattacagcttcaactttggcttgccaccagcttgtcgtgtctctgtctgaagcttacttgagcaaaatatttgatgctccaaagagatacgcagtcagtgcatga

SEQ ID NO: 4362 - DNA, 747 bp, Glycine Max
atggcgactaaagaattatttcactcatcagatcaagaagaagcagtaaatgaagaaagcactctactgcagcatgaggtagatccatacgaagaagaagaaactctatctctttctgaccttccaatttacagtggcgcctcaatttcagctagatggggtggtgatttctccaaagaagatggaaaaaactttgttgacgatgacgacgataatttgttcgagttcttcagtgaagaattcaccgcatcatcaaccaattatgcaaccgcagagaatataatcttctgcggcaaactcatccccttcaaagatattaatcctccacgtggtgatcagagcaatatcaatgtccaaaagggtattacaaaacgcagttcaaagggttcaaagagtagttttgcagccagtgactactcatcatcggttgggaaggtgtcactggtgaggagtcccacaaagtcaagatggtttttgttcatgtttgggatgtcaaagttgtccatcaccactgagatggaactcaaagacattagaaataggcaaagccgccgccggaggggacccacggcgacgatgatgattccggctgcgccggaaaatggaaaagaagaggtggctgctgtgaaggagaagagaagcagctgcaaagggatgtggaagatgttcagatcaatctctatggtgttaggttgccatagtagtaataagattgcaaacgacgtagtaaaggctgcttttgtgtga

SEQ ID NO: 4363 - DNA, 567 bp, Glycine Max
atggcggcaaggatgttgcagaggcgattcatttcaatcttctcaagacaaacccatcaccccattactcaagaatcttggtattctcctaccagtgcaatattaaacagttatggattccatcaacggggggtcatgacccatacaaatccaatcaaacctgtctgtgaagatgtagagaataatgaagcagacaccttaaaatcaagtccaaacccagatgaagttgctacatctattagtgttaatgaaacctcttctgtaaagttttctgccaagtccagtttgaagacatcctcaaggcatgatcttgctatggttttcacctgcaaggtctgtgaaacgagatccattaagacggcttgtcgcgaatcgtatgagaaaggtgtagtggtggcaagatgtggggggtgtaataaccttcacctgattgcagatcaccttgggtggtttggtgaaccaggaagcgttgaggacttcctggctgctcgtggagaagaagtgaaaagaggttcagttgacacactgaatcttacattggaagatttagctggaaggaaaccttga

SEQ ID NO: 4364 - DNA, 1491 bp, Glycine Max
atggcggcagcttcctcatccactccatttttgggaatcagagaagaaagccctcagattacaacacaccatcaaccctccacagtttctccaaccacagcgcctcaaaagaaacggaggaatcaacctggaacaccatgcaaggctcttgacttctttaatgatccagatgcagaggtgataaaactatctcccaagaccctaatggcaacaaacaggtttatatgtgaggtgtgcaataaagggttccaaagggagcaaaacctacagcttcacagaagaggacacaacctgccttggaagctaaagcagaagagtacaaaagagcaaaaaagaaaggtttatctgtgtcccgagcccacttgcgtccatcatgatccttcaagggctttgggagacctcactgggatcaagaaacactactatcgcaaacacggtgaaaagaagtggaagtgtgaaaagtgctcaaagaaatatgctgttcaatctgattggaaagcacattcaaagacttgtggcactagagaatacagatgtgactgtggcactctcttctctaggcgtgacagtttcatcactcatagggcgttttgtgatgcgctagcacaagagagtgcaagattccccggtggcttaaaccctttggggactcatttgtttggcacaaaccacactactagtttaagcctatcccaagtgggtaaccaactttcccaagttcaaaagcagaaccaaaccgccactaattataacagcattttgcgccttggcaacaataatgttggtgcagcagcaacaaagtttgagcacttgattccacctctaaaccattcttcatttggacactcaccacaatcaatgccttcctcagctttcttcatgaatgacaacacaaatcaagcattatttgaagaacaccaatcacaactacaaggcctaatgcaactccaagatcttcaaggcaacacaaacaactctgattcttcatcagtaggtcctcctaattccaatcttttcaacctcagcttcttcccaataaaaaacgagtcatcccctcatgctggatcgagtttttcttctatctttggcaattcaatagaaaatgcgtcatcctctcatatgtctgccactgcgttgcttcaacaagctgctcaaatgggttcaaccacaaccacaaccaccaacaacggttcttctttacttggaggaatgtgtactaacaatagttccaaagctgaaaatgaccaccaccacaatcttcaagggttgatgaactctattgccaatggaaacacgtcctttgtaaactttggaggttctgataagttgaccttagactttttgggtgttggaggaatgatgacaaacatgagtggtggattttcacaaagagaacaacaacaacatgtcacaggtactatgagctctttggaccatgacctaaagtcagcacagtcatatcgtcattttggaaagtcaacgttgcaataa

SEQ ID NO: 4365 - DNA, 816 bp, Glycine Max
atggcggcgccgaggaatgtgacggcgacgagggacgaagagaagggcgaggaagacgattcgccctccgccaagaagcccaaatcggagaggttcccactgaacacgtgggaattcgccgtcgccgtcgccgtcttcttcgtgttctccaccggcctcttctgcgtttacctctccttgccctccgccgcttacaccaacctcaagctcccccgcacgctctccgatcttcgcctcctcaaggaacatctttcggcgtatgcgagtaaccaccctgcgcagttcattcttgggtactgctccacctacatcttcatgcagactttcatgattcctgggacaatcttcatgtccctcttggctggggcgcttttcggagttgtacgaggaatcttattggttgttttcaacgccactgcgggtgcatcttcatgtttctttttgtccaagttgattggaagacctttggtttcttggttgtggcctgaaaaactaaggttcttccaagctgagattgcaaagcgtagggataggttgctgaattacatgctttttctgaggataaccccgacattgccgaatctgttcatcaatttggcgtctcctattgttgatgttccctttcatatattcttttcggcgacattgattgggcttgttccagcctcttatattactgtcagagctggccttgcccttggggatctaaagtcaattaaggatctatatgattttaagacattatcggtacttttcctcattggttttgtttccatagctccaacacttctgaagcggaagcgagtatatgaataa

SEQ ID NO: 4366 - DNA, 528 bp, Glycine Max
atggcggtctccgtttccgcgtcctccgcgattgcttctttgaactccgaacgctccacgcgcttggcaccctcactcgtctccgcatcttcttccgccaagcaatcctcgctgcaattcacgtcgcccacgcgccttcttcggattagtactccacgcgctcccgctccttcgcgacctcgattccttcctctggttcaagcgaagaaacaaacctataactcgtttgaagatttgcttgccaattctgaaaagcctgtgttggttgacttctatgcaacctggtgtggtccttgtcaattcatggttcccatactcaatgaagttagcactcggcttcaggataagatacaggtggtgaagattgatactgagaagtatccaaccattgctgacaaatacagaattgaggcgttgccgactttcatcatgtttaaggatggagatccttatgatcgctttgagggagcattgactgcagatcagctcattgaacgcattgaagctggcctcaaggttaagcaataa

SEQ ID NO: 4367 - DNA, 1131 bp, Glycine Max
atggcggtgatggcggttcaccaattcgcgcaatgcatcacttgccacgcttggagccccgatcaatccatggttgctttatgtccaaacaataatgaagtgcacatctataggttggttgaagacaaatgggaaaagttgtatgttcttcaaaagcatgaccaggtaatttctgggatagactggagtgcaagatcaaatagaatagttactgcatcccatgatcggaattcatatgtctggaacctggaaggatcagaatgggtgccaactcttgtgattcttagactaaaccgtgctgctctttgtgttcaatggagtccaaaagaaaacaaatttgcagtgggaagtggagccaaaactgtttgtatatgctactatgagcaggagaacaactggtgggtcagcaaacttatcaggaaaagacatgattcttctgtgacaagtgtttgttggcatcccgataatattcttcttgctacaacatccacagatgggaaatgcagagtattctccacctttataaaaggcgttgatgcaagggattcgaaaaagggtacttcaccagattcaaaatttggagagcaaattgttcagcttgatctctcatcgtcttggacattcggagtcaagtggtcaccaagtggcaatactctagcgtatgtaggtcataattctatgatatattttgttgatgatgttggtccttctcctttggcccaaaatgttgtgttccgtgatttgccgctccgtgatgtattatttgtttctgagagaaaagtgataggtgtgggatttgattgtaacccaatggtttttgctgcagatgaaaggggaatttggagttttgtcagatatttggcagaacggaaagcagtatcttctggatcaagatatggctcacagttctctgaagcatttggaaagttttatggccaatcgaagcatggagtgagcaatgatacagttgaaacttcaagaactcgtggaactgttcacgaaaactgtataaattgtattatgcctcttggggatcatggcacattgctaaggcgtttcagcacatcaggattggatggaagaattgttgtatgggatttggaaaatgagcaagacctgttggaattataa

SEQ ID NO: 4368 - DNA, 753 bp, Glycine Max
atggcgtcaggggacacagattccttcagcgataaggtagaagagaagttccacgaccacaactccgattccgattcctattccgattccgatgacgaccacaacaacaggccgccgcccaagaccaccgtttccaacaacgtttaccgcctcttcggtcgcgatcagcccgtccacaaggtcctcggcggcggaaaacctgctgatattttgctatggaggaacaggagaagcactggagtcgtacttggtgcaggcactgccttctggattttctttgagttgatgcaataccacctcataacttttatttgccatttattgattgtgtctctcgcggcacttttcttgtggtccaatgcatctgtctttatccacaagtcttcactgcacatccctcatgtagcacttcctgaggaatgcgttcatcaggttgcttctgctttaacaattgagattaaccgagccttcgttattgtgcgggaaattggaactgggagagatttaaagaagttccttagcgttattgctgtattatgggttatctcggttattgggagttggttcaacttcatgaccttgttttacctattttttgtgtcactgttcacgttgccactgctgtatgagaaatatgaagaccaagttgatgcattaggagagaaggcaatgattgaaatcaaaaagcagtatgcagtgtttgatgctaaggttttgagccagataccaatagcaggttttaaaaaggattag

SEQ ID NO: 4369 - DNA, 126 bp, Glycine Max
atggctaaggaaaaggctcagatcaacattgtggtggttggtcatgtggaccctgaggaggcaaccaccattaacgagctgaagaagcctgttgtggagaaagaagctccagggcatgccatatga

SEQ ID NO: 4370 - DNA, 126 bp, Glycine Max; identical to SEQ ID NO: 4369

SEQ ID NO: 4371 - DNA, 1821 bp, Glycine Max
atggctagcatgaagctgggatccaaatctgaaatgttttacctctatggccaaagttggttgtgctcaactggacttccaagtgatgtcattattgaaattggtgacacatctttccatctccacaagtttccactgatatcaagaagcaaagtgctagaaagtatgatgaaagaaatatcaagtgaacatgagaagtctgttttggaacttcatgacctaccgggaggagccaaggcctttttgcttgttgctaagttctgttatggtgtcaaaatggagttgactgcgccgaatgtggttggtctcagatgtgcggctgagcacctacaaatgactgagaattatggagagggaaacctgatcacgcaaacagaacatttccttaatcatgtgtttagttactggacagacactcttgaggctctcaaaacatgtgaagaggttttgccttttgctgaagagcttcacatcacttcgcgaagcatacattctttggtgttgaaagttgcagatcaaagtttggttagttttcctgtctccacatctcaaagtgttactcagagtccagacgatgcagaagtgtggaatggaataagcctaacaccaaagacctcaggtgaagattggtggtttgaggatgtttcttctcttagtttgccattgtacaaaaggttcatgcaaggggctagtgcaagacaaatgaagcctaagagaattgctgaatcccttgtttactatgcaaaaaagcatatccccttattgagaagtcaagcaagttctcagaatggaaactcatcatcttttaagtcaactatttctaccccttctgaagcagatcaaaggaatcttattgaggaaatagtagagttgcttccaaatgaaaagggtatagcaccaaccaagtttttgctggggtgtctgcggacagcaatggccttatatgctagttcatcttgctgtgcaaacttggaaaaaagaattggtgctcaattagatgaagcagacctggaagatcttttgattccaaatattggatactcaatggagactcttcatgacattgactgtgtccagagaatgcttgactatttcatgattgtagagcatgatgtaattgattctacatcaaacgatatagaggaagaagggcgcatagttggatgttctcaacctgagagtccaatggcaaaagtggctaacctgatagattcttatttagctgaagtagcacctgatgtaaatgtgaagttaccaaaattccaatcacttgctgctgtacttcctgattatgctaggaccctggatgatggcatataccgtgccattgatatatatctcaagagtcatcaatggctgacagactcagagaaggaacaaatctgcaggctgattaattgccagaagctgtcactggaagccagcacacatgcagctcaaaacgagaggttaccacttcgcgttgtggtccaagtgttgttctttgagcaactgaagcttcgcacgtctgttgccggctggttctttgcttctgacagtgttgagaacacacaaaacctgagtgcaaatcttggtctgataagaaacgatggcaacacgccacccaacccggttttggccttggataacatgaaagagagagtggctgaacttgagaaggaatgcttgagcatgaagcaagatttggaaaaaatgatgaagtctaagggaagttggaatatgctccttaagaaattgggttgcaagcttccatgcaggaagtccaaaatatcaccagcatccacaactccaatggaagaaaaggccatggaagtgaactaa

SEQ ID NO: 4372 - DNA, 1845 bp, Glycine Max
atggctcagattcccaacctagacaatgctcctgtcaatctcacatccattagggagcattcgcaaaaagagctcctcaacatcctcaagaatgttcgaggaaagaagtgtttagtcattgatccgaagctcggagactctctctcgcttatcatacagacatccattctcaaggagcatggagttgaattgcggcatctttccggggacccaattcaaactgactgcagcaaagtagtttacattgtgcatgctcagcccaagttgatgagattcatatgttctaatattcataatgatgtatcgaaaggactgcaaagagaatatcatgtttattttgtccctcgccgcactgttgtttgtgagaaagttcttgaggaagagaaattacataacatggttacaataggggaatatcccttgtatagtgtaccaatggatgaggatgtattatcatttgaacttgatctctcttacaaagaatgccaagttgatggtgatacaagctcactttggcacattgctaaagccattcacaaacttgagttttcttttggagtgataccaaatgtgagggcaaaaggaaaagcatctgtgcgtgttgcagacatcctaaaccgaatgcaagctgaggaaccagttaactcatctgatatggttgtgccagagataaatacagtaatccttttagatagagaggtggacatggttactcctttgtgttcccaattaacatatgaggggctacttgacgaggcaaatttggttgtgttgttatttgatcaggcttttctttttgagaatatcccttttctgcacatcaacaatggttctgtagagcttgatgcatctattatgggtcttcagcaagaagggaagaaaactaaagttccacttaattcaagtgacaagctttttaaggagatacgagatctcaactttgaagttgttgtccagattttgcgccaaaaagctacttccatgaagcaagactacacagaaatgacaactactacgcagacagtttccgagttgaaggactttgtgaaaaagctgaactcattgccagagatgaccaggcacataaatcttgctcagcatctatcaacattcacatcaaagccttcatttcttgggcaacttgatatggaacatacaattgtagaggcccagagttatgatatatgctttgagtatattgaagaactgatccataagcaggagcctttgacaacagtcttacgccttctaatcctattttcgattactaattctgggttgccaaagaagcattttgactacttcaggagagaactactccacagctatggatttgagcacatagcaatgctaaacaatttagagaaagctggactttttaaaaagcaggagtcaaaaagcaattggcttactataaaacgtgctctacagcttgtggttgaagacactgatacggccaaccccaatgatattgcttatgtcttctctggatatgcaccactcagcattcgactggtccagcatgccattcgatctggatggcgtcctgttgaagaaattttgaagctactgcctggacctcatttggaaatgaagaggggtggattctcaaatagcccatcatttgacactttatcagggattcaatccagcatagccaaagtacctgatggaaggcgtgctgtggtgcttgttgtctttgttgggggcgttacctttgcagagatttctgcacttcgatttttatgtactcaggagggaatggcatatgatttgattattgcaacaacaaaaatagtcaatggccaaaccttggttgaaacgtttatggaaaagctaggttga

SEQ ID NO: 4373 - DNA, 1803 bp, Glycine Max
atggctcagcagaggcaatcgggaatggagaggtttggggtgagagatctgcaccacaccaacggcgctggcgatcacgtcgccgtcgggattcgcggttgcgcagccctcaagcagccgcggctccggcgatcggcgcgatccgacagggccacgcacctttcggtggcggcaatcctcgttttcctcttgctcgtacttgtcgtcactttgctcgtgttctcttacatttctagagacgaaataagtaacaatggcgatgatagtgatgatttaaagagtgattctgattttcttacaaatgtaccacggatacagaggaagaaagtccttgactttgggcatggctctgggggacatggccgggattcgagatattgggatagggatgataggagaagggatggtgattacgacgaggatatgatggagcagacaagtgatggcttgtataatgaagctggacgtcatgagttgaaaaggtatgaggcagaatatgaggcttctttgaagaatttgggacactcaactgaagatgatgggaaagaaaacgacgatgatgttacttctgaagatgttgaagaggcatcttccttgaataaaaaaaattctcatgatggaaaaacaaattctaaacatgcaaatcattctaatggacaatcaattagaaaatcacatcctgaaacaaagaagaaagccaaacgacacaaattttcaggatcctgtgatatgaaattgttaaactcgacttcacagcttgtagaaccactagaaagtcgaaaattttcaagatttaacttacagtacacagagacagaagagaagccccagggagatgaacaatgggtgcccagatttgctggtcatcagagcttagaagagagagaaagttcatttttggcacgtgaccagcaaataaactgtggttttgttaaaggtcctgaagggtttcaaagcactggatttgacttgacagaagatgatgcaaattacatcagcaggtgccacattgctgtgatttcatgcatatttggaaattctgatcgcttgaggaccccaaccaccaaaacggtgactcgattgtcaaggaagaatgtctgctttgtgatgtttactgatgaagttacaatacggaccctttcttcagaaggtcatgtgcctgatagaatgggtttcattggtttttggaaattagtggtagtgaagaatctaccctatgatgatatgcggagagtgggcaaaatacctaagctattgccgcatcgactttttccttttgcaaggtattcgatttggttggatagcaagttacggctgcagcttgatcctttacttatcttggagtactttttgtggcgaaagggttatgaatttgcaatatccaatcactacgatcggcattgcgtgtgggaagaagtagcacagaacaagaaattgaacaagtataatcatacagtcatagatgaacaatttgcattttaccgggccgatggactggaaagatttgatgcatcagatcccaacaaacttcttccaagcaatgtacccgaaggttcttttattatcagagcacacactccgatgtcaaatttgttttcctgtctttggttcaatgaggttgaccggtttacccctcgtgatcagctgagttttgcacatacttatcagaagctgagaaggatgaatccagacaaaccttttcatctgaatatgttcaaggactgtgaaagaaggcacatagccaagttgttccatcataggttggatgagaagaggataaatcgtcaaaaaacaccagaataa

SEQ ID NO: 4374 - DNA, 1407 bp, Glycine Max
atggctcagcttctccacactcccttcatcccttcctcctcctccgcgctccgccgcgccgccaccattccccaccgcaaaacgacctctcgcctcgtcgttcgggccaagatccgggagattttcatgccggcactgagctccaccatgaccgagggcaaaatcgtctcctggaccaaatccgaaggcgacaagctctccaagggcgacagcgtcgtcgtcgtcgagtccgacaaggccgacatggacgtcgagaccttctacgacggctacctcgccgccatcgtcgtcgaggaaggcggcgtcgccgccgtcggatcccccatcgcattccttgccgagaccgaggacgagattcctcaagccaagtccaaagcctcttcttcttcctcttcctcttccgcacctgcaccagcaccagcaccagcaccagcaccagcacaagcaccgccagtggaatctcaaccggaaaaggttgcggcgccagtcgcagctgcggtttcagctccggtcattgcgtccagtcatcctgcttcggagggagggaagaggactgttgcttcaccttatgcgaagaagcttgccaaggagttgaaggtggagttggggaggattgtggggactggaccgatggggaggattgtggctaaagatgttgaggcatttgcggcggcaggtaatgttgcagcggcagcaccggcaccggggaagagtgcagcacctgccgggatggagttgggatccgtggtgcctttcaccacaatgcagagtgctgtgagtaggaacatgctggagagtttggcggttcccactttcagagttggttacaccatcaccacggatgcactcgatgccttgtacaagaagatcaagtcaaagggagtcacaatgacagcattgcttgctaaggctactgcacttgcgctggttaaacaccctgttatgaactctagttgtagagatggtaatagctttacatataatagcagcatcaatattgctgttgctgtggctatagatggcggattgattacaccagtgcttcagggtgctgataagattgatgtctattcattgtcaagaaagtggaaggagttggttgacaaggccagagcgaagcagcttcaacctcatgaatacaacactggtactttcactctgtccaatctgggaatgtttggtgttgatcgctttgatgctattctgccacctggaactggagcaataatggctgttggagcatcggagcccactgttgtggctacaaaggatggtcgcattggaatgaagaaccaaatgcaggtcaatgttaccgctgatcatcgagtaatctatggtgctgatttggcttcattcttgcaaaccctgacccagattattgaggaccccaaagatcttactttctag

SEQ ID NO: 4375 - DNA, 1275 bp, Glycine Max
atggctcagcttctccacactcccttcatcccttcctcctcctccgcgctccgccgcgccgccaccattccccaccgcaaaacgacctctcgcctcgtcgttcgggccaagatccgggagattttcatgccggcactgagctccaccatgaccgagggcaaaatcgtctcctggaccaaatccgaaggcgacaagctctccaagggcgacagcgtcgtcgtcgtcgagtccgacaaggccgacatggacgtcgagaccttctacgacggctacctcgccgccatcgtcgtcgaggaaggcggcgtcgccgccgtcggatcccccatcgcattccttgccgagaccgaggacgagattcctcaagccaagtccaaagcctcttcttcttcctcttcctcttccgcacctgcaccagcaccagcaccagcaccagcaccagcacaagcaccgccagtggaatctcaaccggaaaaggttgcggcgccagtcgcagctgcggtttcagctccggtcattgcgtccagtcatcctgcttcggagggagggaagaggactgttgcttcaccttatgcgaagaagcttgccaaggagttgaaggtggagttggggaggattgtggggactggaccgatggggaggattgtggctaaagatgttgaggcatttgcggcggcaggtaatgttgcagcggcagcaccggcaccggggaagagtgcagcacctgccgggatggagttgggatccgtggtgcctttcaccacaatgcagagtgctgtgagtaggaacatgctggagagtttggcggttcccactttcagagttggttacaccatcaccacggatgcactcgatgccttgtacaagaagatcaagtcaaagggagtcacaatgacagcattgcttgctaaggctactgcacttgcgctggttaaacaccctgttatgaactctagttgtagagatggtaatagctttacatataatagcagcatcaatattgctgttgctgtggctatagatggcggattgattacaccagtgcttcagggtgctgataagattgatgtctattcattgtcaagaaagtggaaggagttggttgacaaggccagagcgaagcagcttcaacctcatgaatacaacactggtactttcactctgtccaatctgggaatgtttggtgttgatcgctttgatgctattctgccacctggaactgtgagtgttttactcgtgctcaaatatggcaagagattgactagttgttccaattag

SEQ ID NO: 4376 - DNA, 969 bp, Glycine Max
atggctccggctagcaaggctgagaagaaggcaacagtggacgcagctgcatgggtgttcaatgttgtcacttctgttggagttatcattgtaaacaaagctttgatggccacttatggcttcagttttgctacaacattaacaggtcttcattttgctactacaactttgatgacaaccttactaaggattctgggatatgtccaaccttctcatttacccttaccagagcttctaaaatttgttttctttgctaacttctccattgttggaatgaatgtcagtctaatgtggaactcagttggattctatcaaattgctaagttgagtatgatccctgtatcctgcctgttggaagtttttttcgacaacattcggtattcaagagatacaaaactgagcataggtgttgtacttttgggtgttggtgtttgcactgttactgatgtgagtgttaacacaaaaggtttcgtttcagcctttatggcagtgtggagcacttctctgcaacaatattatgttcatttccttcaacgaaagtattcactaagttctttcaaccttttgggacacacagcacctgcacaagctgcatcactacttttgttaggccctgttctagactattggttgacaaacaatagagttgacagatatgcttacaatgcaggttctttgattttcatatttatgtcatgcactatagcagttgggaccaacctcagccaatttatctgtattggcagattcactgctgtctctttccaagtactaggccacatgaagacaatacttgttctaataatgggattctttttctttgggagggaaggtctcaatgttcacgtggttctagggatggttatagctgtgtttggaatgatatggtatgggaatgcctcatcaaagcctggtggaaaagagcgtttgaatcacactctccccaccaacaaaatagaaaaccgatag

SEQ ID NO: 4377 - DNA, 642 bp, Glycine Max
atggctgaagagaaacaccacaaacaccacctcttccaccagcacaaggacgaggataataagcccacagaaaccgaaactggttacgacaatacatcttactctaagccttctgatgactatgactctggtttcagcaacccatcgtatgagacttctggcggtgcctatgaaactggtcacaacaagacatcatattctagtgatgatcagccagcttctggtggtggctacaaaaaaacaggttattctggtggcattgatgagacttctggtggcggtggatacggcggtggcggcggtgtgtactctgacactaccactgatggtggatacaccagaacaagtggtggtcggtatggtgatgaggttgactataagaaggaggagaagcaccacaagagtcttgagcaccttggtgagttaggtgctgcagctgctggtgcttacgccttgcatgagaagcacaaggcagagaaagacccagagcatgctcacaggcacaagatagaagaggaggttgcagcagcagctgcagtgggatctggtgggtttgcttttcatgaacatcatgagaaaaaggaagcaaaggagcaagatgaggaagctcatggaaagaagcaccaccatctctttggctga

SEQ ID NO: 4378 - DNA, 837 bp, Glycine Max
atggctgaggactgggatctctttgccatcgtgagaagctgccaatcagccaccacaacaattccacaaaccaccaccaataatacttcctcttccttagttacttccactatcaaggaagaaatatatgatgcattttcctctcccaatatagtgccacccaataccaatgagtttcaagagctacaccaattgttcacaccctttaaccccaccaacaacactagtgctccgggcatcaatcccaattccccttattttgcagaacaagaaagccagcaaatcagtgaacaccttcatatttggcctcattttcaacagatcaatcaactacaggcacttcagaaacacgaatttcgactaccccagaacatttctcccacagtttcaccaaacgcacaacctcaaacacccaaatcaagaaaaagaaaaagccaacagaagaagatggtgtgccatgtaaccgcagataacctctcagcagatttgtgggcatggcgaaaatacggacaaaaaccaattaagggttctccatatccaaggaattactataggtgcagcagttccaaaggttgtatggctcgaaaacaagtcgaacggagtaacactgaacccgacatgttcgtcgttacgtacaccggagaccactcgcatccccggccaactcaccggaactcgctcgccggaagtacccggagtaagactctggtaaccaatccgccaccgtcacctgggtcactctcctgcttccaagccacccctttttcttcttcttcttcatcgccaccacactctccaacgtcgccggaggaagatccacggaaaccgccgatttag

SEQ ID NO: 4379 - DNA, 1278 bp, Glycine Max
atggctgcaaggcgcgtgtaccaagtttggaaaggaagtaataaattcatatgtggagggaggttggtattcgggcccgatgcgaggtccctgtttgtcaccttgttgctgattattgttccagttatcatcttttgtgtatgtgtagcaagccatctccggcatgaattttcttcgtataattctggatatgctattttagtggtggctattctctttactattcatgtccttgtggttctctttctcacttcatcaggtgatccaggcatcgttccaaggaatccatatccaccagaagaagagtttcgttatgattcttcagtttctgttgatgctgggggagctggacgacaaacgccaagtcttcagttccctcgaacaaaagaagttgtagtcaatggcattgctgtaagggtgaaatattgtgagacttgtatgttgtatcgtcctcctcgttgctcgcattgctccatttgcaacaactgtgttgagcgttttgatcaccattgcccttgggtgggccaatgcattggtctgaggaactatcgttacttcttcatgtttgtttcttcagcaactattctgtgcatctatgtgttttccctctcggctttgtacatcaaggttctgatggataattatgacggcacagtttggaaagcaatgaaagaatcccctgcttctgtgatactaatggcttattgtttcatctctttgtggtttgttggtggactgactggttttcatttataccttctaggcacaaatcagactacctatgaaaatttccggtacagagctgacggaaggatcaatgtttttaaccggggctgcttaaataattttctggaaatgttttgcacaaaagtaaagccctcaaggaacaatttcagggcatttgctcgagaggaggtaccaccgagaccgcgggctccgatcattccccgggatcgtgatgacttgggcggagatcgccgccctaaggttgaagccgatcttgatattggtgaagacctattgaagatatcacagcgcaggaacattgaagaacttgacgaggacattcagggcagagggagcaatggaccacccggcaatacatctgaacctgactcaattatgtcctcagatcatcgagctcccacaattcgatccgatgctaggcacttgagttgggaaaggagtggaaactgggaaattgcacaagatgtccttgccaattcaaatgtcacagaaagcagaaactatgtgacttcaaaggaaatgcgccaatga

SEQ ID NO: 4380 - DNA, 1311 bp, Glycine Max
atggcttcttctctctccaccaaaccattctcatcaaccgacgctctctccgccttcgcttctctcaatcccgatctccgatccttctcccccggctacctccgtctctcactccgtcctcgtcttcccaagagacttcagatacgggctgctgggagtatctatggaaatcactttcgtgtttcaacatatggagaatcgcatggaggaggtgttggttgtattattgatggatgtcctcctcaccttcctctctccgaagctgatatgcaattggatcttgacagaaggaggccaggtcagagccgaattacaactcctagaaaggagactgatacatgtaaaatattttcaggagtttctgaaggacttactactggaactccaattcatgtatttgtacccaatactgatcaaagaggacatgactatactgagatggcagtagcttataggccttcccatgcagatgctacctatgacatgaagtatggtgtcagatccgttcagggtggtggtagatcttctgcaagagaaacaattggaagggttgcttctggtgctgttgctaagaaaatccttaaagacttttctggaactgagattcttgcctatgtctctcaagtttataatattgttcttccagaggaccttattgatcatgacactctgactcttgatcagattgagagtaacattgttcgatgtccagacccggaatatgcagagaagatgatatctgcaattgatgctgtgcgagtgagaggtgattctgttggtggtgttgtaacatgcattgtgaggaactgtccacgtggtctcggttcaccagtatttgacaaacttgaagctgaactagctaaagctgctatgtcattgcctgcaaccaagggctttcagtttggtagtgggtttgcaggcacctttttgactgggagtgaacataatgatgagttctatatagatgaacatggaaacacaagaacaagaacaaatcgctctggtgggatacagggtggaatttccaatggggaaatcattaatatgagaatagctttcaagccaacatcaacaattggaaagaagcaaaatactgtgactcgagataaaaaagaaacagagtttatagcccgtggtcgccatgatccttgtgttgtcccaagagctgtacctatggtagaggcaatggtagctttggttcttgtggaccaattgatggcacaatatgcgcagtgtaatctgtttcccgtaaactcagatttgcaagaacccctggtgcccatattacggccagaagaagcgcttctctga

SEQ ID NO: 4381 - DNA, 1170 bp, Glycine Max
atggcttcttctctctccaccaaaccattctcatcaaccgacgctctctccgccttcgcttctctcaatcccgatctccgatccttctcccccggctacctccgtctctcactccgtcctcgtcttcccaagagacttcagatacgggctgctgggagtatctatggaaatcactttcgtgtttcaacatatggagaatcgcatggaggaggtgttggttgtattattgatggatgtcctcctcaccttcctctctccgaagctgatatgcaattggatcttgacagaaggaggccaggtcagagccgaattacaactcctagaaaggagactgatacatgtaaaatattttcaggagtttctgaaggacttactactggaactccaattcatgtatttgtacccaatactgatcaaagaggacatgactatactgagatggcagtagcttataggccttcccatgcagatgctacctatgacatgaagtatggtgtcagatccgttcagggtggtggtagatcttctgcaagagaaacaattggaagggttgcttctggtgctgttgctaagaaaatccttaaagacttttctggaactgagattcttgcctatgtctctcaagtttataatattgttcttccagaggaccttattgatcatgacactctgactcttgatcagattgagagtaacattgttcgatgtccagacccggaatatgcagagaagatgatatctgcaattgatgctgtgcgagtgagaggtgattctgttggtggtgttgtaacatgcattgtgaggaactgtccacgtggtctcggttcaccagtatttgacaaacttgaagctgaactagctaaagctgctatgtcattgcctgcaaccaagggctttcagtttggtagtgggtttgcaggcacctttttgactgggagtgaacataatgatgagttctatatagatgaacatggaaacacaagaacaagaacaaatcgctctggtgggatacagggtggaatttccaatggggaaatcattaatatgagaatagctttcaagccaacatcaacaattggaaagaagcaaaatactgtgactcgagataaaaaagaaacagagtttatagcccgtggtcgccatgatccttgtgttgtcccaagaggttaa

SEQ ID NO: 4382 - DNA, 744 bp, Glycine Max
atgggaaactgcttctttggggccatgtcagatcctgatgcagcagcaatcaaagtgataacatcaaacggtggtatcatggaattcagtgctccagtgaccgtgagtttcatcaccaacgagttcccggggcacgccattttcagaagccacgacctcttttggaaaccactaagccaattcgaagaactggagccaggccaatcctactatctgctaccattcagcaacagaaacaacaacaacaacaacaacaacagcaacaataatatagacactctaccatgtgatggtgaaaatgttaacgttgttgtgagacaagggcatgttagatctcaaagtgttcctacaatctcaaaccctgccttgtatagaatgtccttggactaccaccaccacaaccagggaatggggttgctcaagaggtcctcgaataataacattgatgccttctctagcaggagcagtggtgttgttaatagcagcaacagtattggtggtggtggtagcagtaggttttggaaagtgaagcttgtgatcaccccagaacagttgctggacattttggcacaagaggctcgaaccaaggagttgatagagagtgtaaggatggtagcaaaatgtggaattaatgctggtggtgctatttcaaattcagctgcaggtatgatttctgatcagtggagcctttccagctccagttggagtatttcctccaagattgatgccttagtaggcatttaa

SEQ ID NO: 4383 - DNA, 269 bp, Glycine Max
atgggaagaaaggccaattgtgacaatcaatatgctatgaacagaggtccttggtctgctgaagaagacaaaattcttatgaacgacgttcaagttcatggggaaagaaaatggagagagctttctaaaagagcaggcttgaaaagatgtgggaagagttgtagactccgatggctgaattatctcaagccagatatcaagagaggaaacatttcttcggatgaagaagatctcattatcagactacataagctcttagggaataggtg

SEQ ID NO: 4384 - DNA, 387 bp, Glycine Max
atgggaatttcttcacagccttctcttgtttccctttctttgaaagatctgattcagggaactgaagaaaacagaacatcttcatcatatgggtgtttgcggagcaaagccttggcagcacaagccaagaaggtgaagggtacaaagagaagtgttaggaggccaaggaggattttgatgatgaagagaagaagtggttctagaagaggatccaacaatgggattagaagacgtgtgagaaaattgaagagccttgtgccaaatagtgactctttggagttggatggactcttcagagatactgctgattacatattgtctctacaaacgagagtgagagtcatgcaggttatggtgaaggtattgacaggctctgacgacgagtga

SEQ ID NO: 4385 - DNA, 3339 bp, Glycine Max
atgggaatttttgatgagttacctttgccttcagaaaaagcttatttgagagaagacctctctagaatagatgagagttgggttgctgctcgttttgattcactacctcatgttgttcacattttgacatcaaaagaccgtgatgctgccgctcaatttttgaaggagcaaagtgatattattgaggaggttgtggatgaagtagtacattcctatcatagtggcttcaatagagctatccaaaactattcccagatcttgaaactcttcagtgaatccactgaaagtatatctgtcttaaaagtagatttgggagaggccaagaggcgccttagtgcccgcaataagcaattgcatcaactatggtatcggtcagtcacactgcgacatataatatccttattggatcaaattgaagacattgccaaggttccggctcgcatcgagaaactcattgctgagaagcaattttatgccgcggttcaattgcatgtgcaatcaatactgatgcttgagcgaggcctccaaactgttggggcgcttcaagatgtccgttctgagttaacgaagttacgtggagtcctcttttataagattttggaggatttgcatgcccatttatacaataagggtgaatatagtgctgctggctcaagtttgttagagaatgatgacgaaataccaaccaccactgctgttgcacttgctgcacataattcacaacctctgtctcgaagaacaagatcactcaaaggtgacaatcagaataatctccagattgatggatcgtataggccagcatctgtggatggaggttcttttgatggccatgatgaggcagatttgaatgaggaagctaccttagatgggaatatggcaacaacgagaatcaatggtaatgatataccaaaggattccaacaatgctcttcgtcaaatgccaacatggctctcaaattcgacacctgatgaatttcttgaaacaattagaaaaagtgatgctccgcttcatgtgaagtatctccagaccatggtcgagtgcctttgcatgcttggcaaagttgcagctgctggagctattatatgccaaagattgcggccaacacttcacgagataattacatccaagattaaagctcatgcagagcttttgaattcatcaaggtctagcattggtcaggattcccaggctggaacaggtaatctgcacttcataaaaggtcaactagaaagttatcagttgccaaaacagaagcgtaagaatggaatatctattgctggaactctgttggctgtgagccctgtatcacctcttatggctcctggtgggaaagcacaggttgctgctaaggagcttcttgattcaattttggatgctgttgttcgaatatttgagaatcatgtcattgttggggagcttttggaagcaaaagcaagtcagcatgctgacataaacacgccaaaatcattgccagtagatgtaaattggaaccctgattctgaagcatctcaagtcaccggaggttacagcataggtttctccctgacagtgttacagagtgaatgccaacaacttatatgtgaaattctgcgggccactcctgaagcagcatctgctgatgctgctgtgcaaacagctaggcttgcgagcaaagtcccttctaaagataaaagggatggatctgaagatggtcttacctttgcatttcgctttacagatgcttcaatatctattcctaaccagggagttgatcttgttcgccaaggttggagtaggaagggtcccaatgtgcttcaagagggttatggttctgcagcagttttgcctgaggagggcatatatttagcagcatccatataccgacctgtgcttcagttcacggataaagttgcttcaatgctgccaacaaagtattcccaactcggcaatgatgggttgctagcttttgtggagaactttgtgaaggaccactttttaccaactatgtttgtagactaccgaaaaggcgtacagcaagccatatcgagcaacactatgcttggctcctattttggtctattgtgcatcttaattattttttttggaaacatccaagttgtagtatgtcaattatgtgttgaaagagtattgaagttagctttgtctgaaatgtttgatgtaaatggtccagctgcatttcgtccaagggcacatgttgctactacttacacttcatcaattgagaagggtcgacctgttttacaaggattattagctatagatcacttaacaaaggaggtgcttggctgggcacaagcaatgcccaagttctctaatgatctggtgaagtatgtgcaaacttttctggagaggacttatgaaagatgccgaactgcatacatggaggctgttcttgagaagcagagttatatgcttattgggaggcatgatattgagaagttgatgaggattgacccctcaagtgcatatttaccgaatctgcttggtcagttaaatgtggaaagtaattcatctgatgctgaaacaattgaggctgaattagaacttagtgaattactgctaagtttgcgtcctattaagcaggaaaacctaatccatgatgacaacaaacttattctgttggcatcccttagtgactcattagagtatgttgcagactctattgaaaggcttggacagacaactcaaagagcatcaaatcatgttgggggaaaataccatcacagtcattcagacagtgcacctacaaggagtttagtttcatttgctcaagattataggaaactggcaattgattgccttaaggttttacgcatagagatgcaattggagacagtattccatatgcaggaaatggcaaatacagaatacttggatgaccaagatgctgaagagccggatgacttcatcatttcgctcactgcacagataacacgaagagatgaggaaatggctccttttatttcaaatgcaaagcggaattatatatttggtggaatttgtggggttgcagcaaatgcatctgtcaaggctttggcggatatgaaatccataaatctttttggtgttcagcaaatttgtcgaaatgctattgcattagaacaggcattggcagctattccatccataaatagtgaagcagtgcaacagagattggatcgagtccgcacctactatgaactattgaacatgccatttgaggctttggttgccttcattacagaacatatacacttgttcacccctgtggagtatgccaagcttcttaatgttcaggttcctggaagggaaattcctcctgatgcacaagatagattatctgaaatattatccgtgtag

SEQ ID NO: 4386 - DNA, 4035 bp, Glycine Max
atggggaagaagaagccgacggcgagggacgaagagaacgcgtcgcagcaaggcggcggcgggaaatcgaagaagaaggcggttgtcatcgacgacgatgagtactccgtcggaactgagctctccgaggagcaggcaccggcgtcagaggagaaacccgccgcggcgggaaagaagaaaggtaagaaaggtaatgctaaagctaagaacaatgatgatgatgttgatgaggatgaggatgtttctggaattgtgtttgctgggaagaagaaggggaagaataagaaaggtggtgggagcagtgcgttcactgcttctggctttgatttgcttggtgacgaggaagatgatgatgaagagaaatctgggttgaccggtgaggttgatggtgaggaagaggatgaacctgtggttagttttacggggaagaagaagtcatccaagaaaggaggtggtagtttgttcagtgcatctgcttttgatgatggtgaggaggaggaggatgagacagtgattagtttttctggcaagaagaagtcctctagaggttcgaagaactctgcctcggcttttgatgctattgatgatgatgcggatggtaaggtggtggatgataagaatgacgatgttgatgatgatgatgagcctgttatttctttcactgggaagaagaagtcttccaaagggggtaagaagggtggttctgtgttttcggctgctgttctcggtgagattgatgacgatgaggagaataaggatgatggtggtggtgatgatgatgatgatattggaccgatcactttctctggtaagaaaaggaaatcttccaaaaaggctgctaattccgttagcaaaggtgcttctgttgaggaaggtgatgacaaggatgaggatgatgtttctttagttgcattttcaggtaaaaagaagtcttctaaaaagaagggcagtagtgctgctgccaaagcgagtgatgaaaatgtggatgtagtggagcctgaggcacccagtgttggtagtactgatgctggcaacagcaatgtaaataagagtgaagaggtcgctggaaattctaaaaataaaaagaagaataagaagaagagtggaagaactgctcaagaggaggaagatttggacaaacttcttgcagagcttggtgagacccctcctgtacccaaacccacaactctaccccaggatgataaagttcagcctattcctgaagtagtacctgttgctgatgcttccgggcaaaaggaaggtgaagaggagactgtagagacagctgctgcaaagaagaagaagaagaaaaaggaaaaggaaaaggagaagaaggcagctgcggcagcatcagccgtaggaactgcaccagaaaatggaacagcagaagataaagctgaggtaattgaaccgaagaagaatgattcaaaggctaaaaaagcggctgataagaaagtgccaaagcatgttagggagatgcaagaggcactagctcgaagacaagaggctgaagaaaggaagaaaagagaagaggaggaaaggttaaggaaggaggaagaggagcgtcgtaagcaagaggaacttgagaggcaagcagaagaggctagacgcagaaagaaggaaagagaaaaggagaaactccagaaaaaaaagcaagaaggtaaactgttaactggtaagcagaaggaagaagcccgccgtctggaggcaatgaggaggcagattctcaataacacagggggcatgactctccctggtggggactctggtgctccacccaaaaaacccatatatcaaacgaagaaggtaaaaccaaataatcgtaatcagaatggtgctgctgctgctgctcctgctcagactgctgaaactgttgaagcaaaggagactgatgctgaccttgcttcagaggaaccagaaaagattgaagaagtggagtcggtccaggtggatgacaaagttgaacttcttgtagctgatgaagatgatggggcggaagatgatgacgaggatgaatgggatgcaaaaagctgggatgatgttaatctgaataacaaaggtgcatttgctgatgaagaggttgactcagagcctaaacctatcgtcaaggagattaaaaatgctgtacctgctcagaatgctggtgctactaagcctgtggttgaagaaattgaaaatggaaagcaggctaagcctcacttgaatagggaaccaagaaagtctgctgtgcctcctaagcctagtgatgagaacctccgatccccaatttgctgtatcatggggcatgtcgatactggcaaaaccaagctgctggattgtattcgaggtactaatgttcaggaaggtgaggctggcggcatcacacaacagattggtgctacatacttccctgctgagaacatacgtgaaagaacaaaggaactgaaagctgatgcaaagctgaaagttcccggtctactggttattgataccccagggcatgagtcatttactaacttgaggtctcggggttcaggtctatgtgatattgcaattttggttgttgacattatgcatgggttagagcaacaaacaatagaatcactaaatctattaaaaatgaggaatacagaattcattgttgccttgaataaggttgacaggctttatgggtggaaaacatgtcgcaatgctccaattgttaaagcaatgaagcagcagactaaggatgtccaaaatgagtttaatatgaggctcactcagattattactgaattcaaagaacaagggctgaataccgagttgtattataaaaacaaagaaatgggagaaacattcagcattgtgcctacaagtgcaataagtggtgaaggaattcccgatttgttattactattgattcaatggacccaaaaaacaatggttgagaaacttacatacagtgaagaagtgcagtgcactgttttagaggtgaaggtagttgaaggccatggaactactattgatgttgttttagttaatggtgttcttcatgaaggagaacaaatagttgtctgcggaatgcagggtccaattgttaccacaattcgagctttattgacacctcatccgatgaaggaacttcgtgtcaagggaacatatcttcatcacaaagaaatcaaagctgcaatgggtataaaaatcactgcccagggccttgaacatgccattgccggcactggtttatatgtggtgaagcctgatgatgatttggaagatgttaaagaatcagccatggaagatatgcggtctgtcatgagcaggattgacaggactggtgagggtgtttgtgtacaggcatctacccttggctccttggaagcattactggagtttttgaaaactccagaagtgagtatcccagttagtggtataagcataggccctgtacataaaaaggatgtaatgaaggccagtgtaatgcttgaaaaaaagcgagagtatgcagctatattggcatttgatgtcaaagttactcctgaggctagggaattggcagatgaattgggagtgaagatatttattgctgatatcatttatcatctgtttgaccaatttaaagcttatattgacaacattaaggaggagaaaaagagagaagctgctgatgaggcagtcttcccatgtgttatgagtatcttaccaaattgcattttcaacaagaaggacccaattgttttgggagttgatatccttgaaggcattttaaagattgggactccaatttgcattccttctagagagttcattgatattggtcgcattgcctccattgagaataaccataaacctgttgattatgcaaagaagggacagaaagtagccattaagattgttggcagcaattctgaagagcaacaaaaaatgttcgggaggcattttgagattgatgatgaacttgtaagccatatttcacggagatctattgatatactcaaaactaattatcgggatgaactaaatatggaggagtggaggttggttgtgaaattgaagaatcttttcaagatacaatga

SEQ ID NO: 4387 - DNA, 1839 bp, Glycine Max
atgggggatcgaggagaagacgaggatttgcaaatggcgattcggatgagcatgcagcgtgggacgccggagccgaagcgcagcaagccgcttgacgccgtcgccggggcggtttcggggtcgccagaggagtctccggagtacaagacccggcgacgggagctcatggcggcggcggccgagaagcgtatggcggcagcggcgagggtttcgccttctccgtcaccgtcgccatcaccggtgaaaaagggcggtgaattggggaggagtgaggaagattcgcgtttgaagagtgtgaatttgagtaaggagctttctgcggaagaagctaatcaattgtttggtatggtgtttgggaatgaagtttctaagggcattcttgcacagtggagcaaccagggaattcggtttagctctgatcctgtaacatcaatgggcctagtgcagcatgaaggcggtccctgtggcgttttggcagctatacaagcatttgtgcttaaatacattcttttcttcagtgatgagttgaaagatgtgtcatgcatgtcaccggagggtctgggtgcgtcatttaaaagtcagtctattccatcatataatttttcttcactcactgaaggtgaaaaagtaagagcccttgtaagaagtatgggtgaaattttattttcatgcggaagtaatagaagggctgtgattgcaactttgagcatttccgagaatgacattcagcgttttgaagggatttcagaagttgaggttgttacaaaatcacttcaaggtctttccattgaatctgccttggatctgcaaaaagttcttagagttgaaacatgcacatcacaaacaactgctttgcaaaggcttgaagcaaatcttccccttttccaaagtcgaatgggagcattgcttttcctaatctctgctttactttctcgaggactggacttggttcaaagtgacagggatgatcctagcctaccactggttactgcaccttttgggcatgcctcccaggaaattgtgaacctactgctctgtggggaggctgttcctaatgtgtttgatggaaggatggatttaggtggaggaatgtttgtgaaaggtatatcccgatatgtggaagttggatttcttactctattagaatccctgaatttttgcaaggttggtcagtttctgaaatccccaaagtggcctatatgggttgtggggagtgaatcccattacacagtgttgtttgctcttgaccccagtgtccaaaatgagaatgaactggaaggaagggaaactcagattcgcaaagcttttgatgcacaagatcagagtggaggtggtggtttcattagtgtggaagggttccatcaagtcctcagagaaacaaatatcaaatttccaccagagaagctggaacatctttgctctgcagggttcattgtatggagtgaattctggcaagtaattttggatctagacaaaagcttggggggtttgaaggattcatcaggattgatgggtaagaaggtttttgatctttaccattttaatgggattgccaaatcggatctgaatggaagtcaagtaaattctgggggcgaaactccactgcaaagaccccggctcacaaaattgagagtttcagttcccccaaggtggacgcctgaggaatttatggcagatgtgaaagttccatctgctgctagtgcaagtgagtctgctgggaaggacaatgaagtatctaaaccagagccttctaagcatgcacctttggtggactgcataaggacacgctgggcgcgtgctgtctgcagctggtcaggggatcctcctagtatagtttga

SEQ ID NO: 4388 - DNA, 954 bp, Glycine Max
atgggggattcacaagaaaataacaaaggaaagagtagagacaaagataattatgtatcttggactatggaagataccaatgagttgttgcacctcttggtggatgctatgaataggggattgcgtgatgccaatgggtcacttagcaaacaaaatgtagaacgaataatacttcctcaactcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggattctcacccaagtcacagcaaacttcgaggaaaaagtatggttgattatgagtatttgaagatcgttgttgggggtggagtttctagcgggaataattctatatcagtcgatccagatgatactgatgcaacaacttttgagccagaaaataaaactgttgggatagaagaattttcatatgatcctaatagtgatacattcataacaccaaataactatgaaccagcatatcagcctccatcaccaaaccaaccaagtccaccatcccacccccctttagattcagaggttcccatagaaaaacaaaactgtcacaagcgaaggagatccgagtatggagggagttcaagcgctgttgggatcaacaatcaaggcaacgttctggaaaatctttctgttggcattgagactattgctaaaagagaaaaagatagagatagagatagagagctcgagggtattatttgggatgttataaaagaaattccaaatttggatgacataacgcgtttcaagacagctgaattgttaaatactaaagcaaaaaaggattttttcttgaagatgtcaccggaagaacgctcatcttggataaactttaagttagggaataattaa

SEQ ID NO: 4389 - DNA, 1110 bp, Glycine Max
atgggggattccaatgtcaccaagaatcacctgtttgcaacttctcctcaacaaactgaggatgatgcttgcctatctgcaatgctgctttgcactaatctagtgtaccctgcagtactgaatgctgctattgagttaaacttgtttgagatcatagctaaggcaacaccagctggtacttttatatcatcccatgaaattgcttctaagctcccaacacaacaccctgacttgcctaataggcttgaccgcatgctgcgtttgcttgctagttattctgttcttactacttccactcgcaccacacaacatgcagcctctgagacagtttatggactctcacaagttggacaatactttgttccaaatggaagtagtggctatttggcttcattcacagcatttgtctgttatccaccactcttacaagtttggttgaacttcaaggaagcagtggttgatgcagacattgacttgttcaagaaacttcatggagtaacaaagtaccagtacatggaaaaggatccaaaaatgaaccaaatttttaacaagtcaatggccgacgtgtgtgcaacagagatgaccagaatacttgaaatatacactgggtttgagggaatatcaacattggttgacgtaggaggtggaaatggacaaaatctaaaaatgatattgtccaaataccctttaattaaaggaattaattttgatttgccccaggtgattgaaaatgcaccaccccttccagggattgagcatgttggaggagatatgtttgtaagagttccacagggggatgccataatactaaaggctgtatgccacaattggttagatgaaaagtgcttagaatttttaagcaattgtcacaaagcattgtctccaaatgggaaggtgattgtggtggagttcatattgccagaagaaccagaaccaactgaagcatctcgacttgtttccactcttgacaacctcatgtttatcactgttggtggaagggaaagaactcagaaacaatatgagaatttgtgcaagctctctggattttcaaaatttcaagttgcttgtcgtgccttctctagtctgggagtgatggaattttacaaatag

SEQ ID NO: 4390 - DNA, 1242 bp, Glycine Max
atgggggttgtagaaggaagggggttggaaatgagacaatggcttttcctccgaagattctctctgtggtcgatgaagaaggaacctgacttagaatccgcactctcacgcaatcgccgttggatagtcaacaaccaaatcaagaacatcatcctccgctaccccaacaacgaaatccccatccataccctccagaacaagttcaaaaccctagatctccaaggcaaagcccttaactggctctccaagtacccttgctgcttccaaatccacgacaaccgctgccgcctcaccaagcgcatgatgaacctcgtcgcagaggaacagtccctcctcgattccctagagcccctcttcgctcgcatcttagctaaactcctcatgctatccctcaccaagagactcaccgtcctcaaaatcaacgaattcaaacgtagtttcggcttccccgacgattacatcctcagaatcgtccccaaataccctaatttgttccgaatcgtcaacgaaagcggcaggagaagctccatggccgttgagctgctgcattgggatcccgacctcgccgtctccaccatcgaagcatcggcgaagaagctcggcactccgccgcggttttcgtgctctttgccgtccagttgggtgaaatcatgggagaggtttcacgaatttgagtcaattccgtacttttcgccctattcggaatcgagagggttggtggagggatctaaggagatggagaagaggaatgttggtttggtgcatgagttgttgtcattgactctttggaagaagttttcaattgttaagttgggacattttaggagggagtttgttttgcctgataaattgaatgtgttgctgctcaagcaccctgggattttctatgtttcaaataagtatcagatttacactgtgcttcttagagaggcctatgttgggtctcagcttgtggataaggatcctttggtgattgtgaaggacaagtttggggagttgatgcaggaggggcttcacgagtacaatcagcggcggtgccaacttaatgttgaaaagaggaggaagaaaggggttcctttggttagtgtggatgatggtgcaaggggtagaaggagaagtcgccaagttgttgatgatgatgatgatggtggtggtggtggagatggtaaggtgggtaggttgtttgaccctgaagaaagaaaacggttttacagagttctttttgacgatgatgcttcttga

SEQ ID NO: 4391 - DNA, 1638 bp, Glycine Max
atggggttcttgagcagtttcttgggggtttttggttttgccgttggaatacctcttggcctcttggttgggttctttctctttgtctactcagaaaccaaacgtgtcaaggaccctgttgttaggccaattagtgaattaggcccaaattctctgcaggaacttctgcccgagattcctctctgggtgaagacgcctgattatgaacgagttgattggttgaacaagtttttgttggatatgtggcccttcttagacacggcaatttgtaagattattagaagcacgactcaaccgatatttgctgaatacattgggaagtatcagatcaaagcgattgattttgatgagttaagccttggtactcttcctcctactgtctgtggtatgaaagttttagaaacaaatgaaaaggaattggtcatggaacaagttatcaaatgggctggtaatccaaacatagtggtgtccttgtatgtgtcatctttgaagatcaccattcagttggtagacttgcaaatatttgcagcaccacggattactttaagacctttggtgcctacatttccatgttttgcaaatattgtggtatctttgatggagaagcctcatgtggattttgggatgaacgtatcaggaggggacatcatgtcaatacctggtctctatagatttgtacaggaaacaataaaaaaacaagttgcaaacctctatctctggcctcaaaccctggaaattcctattcttgatgaatcaacggtggcaataaagaagcctgtggggatattacatgtgaatgtggttcgtgcacaaaagcttttaaagatggatttgttgggtacttctgatccttatgttaaactaagcttgacaggagacaaacttccagcaaagaaaaccactgtcaagagaaagaatttgaatcctgagtggaatgagaagttcaagattgttgtaaaggaccctcaatctcaagttctccaattacaagtttatgactgggacaaggttggtggacatgacaagctgggaatgcagttagtccctcttaaagtgctaaatccgtacgagaacaaagaatttatacttgatttactcaaggacacaaatctcaatgaaactccacataagaagcctagagggaaaattgtggtggacttgacttttgttcctttcaaagaagatagtaacaagtttggtggaccttcagaaggatatagcaggaaggaaagtggaattgatattgtatccgatgatgaggtccaagaaggagcaggtttgctttcaattgtgatccaagaggctgaagaggttgagggggaccatcacaacaacccatttgcagtgctgacctttagaggcgaaaagaaaaggacaaagacgatgaagaaaactcgacacccgcgttggaatgaagaattccaattcatgctagaggagcctcctctacatgagaagatacatattgaggttatgagcaagaggaagaactttagttttctgccaaaggaatcattggggcatgtggagattaacctaagagatgtggtgcacaatggtcgcattaacgataagtaccatctaataaattcaaggaatggagtgatgcatgttgagataagatggaaggtggtttaa

SEQ ID NO: 4392 - DNA, 1722 bp, Glycine Max
atgggtaacagcagaaagaagcaccgtcgtgtgcaagactcgccgtcttcttcatcctcttcgtcctcggactccgaccactcttcgcggcggcggcggcggctgaggcggcgcgagaaggagcggcgcagaaagagcgagggaaaggatgagcgaaggagtaagaagagagacaaagagcgcaaaaagaagaagaggaggctccacgattccgatgactcctactcttcggaggagggggaacacgaacaacctagggttcagcctgaaactgtcttaaccgaaatgatgaaagagtttcccgatgtcggcaacgatttgaaacagctcttgcaaatgattgatgatggacaagctgttgacataaagggtatatcagaaaaatctttagcgaagcgtttgaaaaagctgttcctttcgttaaaccttaaggagaatggagatagggttttcttgctgcgttctaaagctcgccctactttggatgttgttggccctctgattcaatcctatatgaatatgaatcccatgaatgagctagctgatacttcggcaccattgcctgaatcaagttcagttccaatagattctggaaatgaacagatggtggatgaccatgcaacggcagctccagaggatcattctgttggtcctcgaagaagggtgattggccctgcaatgccatcagctgaattactcgctgctgctgcgaaattaacagaggcacagactgagctcagagatgccgaattggacgacgattctgaactatttgtaggacctccaccaccagctctagtttctgaagcagaatcagctaatgaagcagaacgctttgaagaggtaaccaggatcatggaagttgaggcagacagcccgtatgatgttcttggagctaaccataatatgtccagtgacaacatgaagaaaaagtactggaagatgtcactattggttcatccagataaatgctctcatccacaagctcaccaggcttttattaagttaaataaagctttcaaagagttacaagatccagaaaagaggaaagcaatggatgagaaaatcaaactcaaacaagaacaagagcaatttcaggctgaacttaaaaccatgcgtgaggctgcactgtggagaagatctcaaggtatttccatggagggtgatgaagagcttctggcacaaacagaggttaaagtagaaccaaaaagggatgagtggatgacaacactacctccagaaaggaaacctggtggtatgactatgcaatcaaccacttttagccggggcccaaaggaaggtagaggtgatactagtgtttggacagacacccctttggacagggcccagaaagcaaagatgaattatttggaagcatacaatgaagctactgcactagcttcaaatgaagaggataagaaaagggctagtgcggatgcagaattggtggacaaatacaataaagcaaaacggtcaaaaacattggtgcagaagtatcaagaagaggttgctagcaaatccaagaaaaagtccaaggaactgaaggaagtgaagcaacagccggagaaggaagactgggtgggtcaacatccatggaagccatgggaccgtgaaaaggatctgacagctggaaggaaaactgtaaattttgattcagaaagcatgactaagaacttatcttcaaggttttcttctggaaattttcagaggaacttcctttga

SEQ ID NO: 4393 - DNA, 1347 bp, Glycine Max
atgggtaaggaaaaggttcacattaacatcgtggtcattggccatgtcgactctgggaagtcaaccaccaccggtcaccttatctacaagctcggaggtattgacaagcgtgtcatcgagagattcgagaaggaagctgctgagatgaataagaggtctttcaagtatgcctgggtgcttgacaagctcaaggctgagcgtgaaagaggaatcaccattgatattgctctgtggaagtttgagaccacaaagtactactgcacagtcattgatgcccctggacatagggatttcatcaagaacatgattactggaacatcccaagctgactgtgctgttcttattattgattccaccactggtggttttgaagctggtatttccaaggatggacagactcgtgagcatgctctccttgcattcactcttggtgtgaggcagatgatttgctgctgcaacaagatggatgccactacacctaagtactccaaggcaaggtacgatgaaattgtcaaggaagtttcttcctacatgaagaaggtcggatacaaccctgacaaaattccttttgttcccatctctggttttgagggagataacatgattgagaggtctacaaaccttgactggtacaagggtccaacccttcttgaggcccttgatcagatcaatgagcccaagaggccatcggacaagcctctccgattgccccttcaggatgtctacaagattggtgggataggaactgtgcctgttggacgggttgaaaccggtgtcttgaaacctggaatggtggttacctttgcaccaactggactaacaactgaagttaagtctgtggagatgcaccatgaaactctcactgaggcccatcctggtgacaatgtgggattcaatgttaagaatgttgctgtcaaggatctcaagcgtggttttgttgcgtctaactctaaggatgaccctgccaaggaggctgctaacttcacatcccaagttatcatcatgaaccaccctggacagattggaaatggctatgcacctgttcttgattgccacacctcccacattgccgtcaagtttgctgaactcttgaccaagattgacaggcgatctggtaaggaacttgagaaggagcccaaattcctgaagaatggtgatgctggtttggtcaagatgattcccaccaagcccatggtggttgaaaccttctccgagtatcctccacttggtcgttttgctgtgagagacatgcgtcaaactgtggctgtgggagtcatcaagagcgtcgagaagaaggaccctactggagctaaggtcaccaaggctgcacagaagaaggccaaatga

SEQ ID NO: 4394 - DNA, 462 bp, Glycine Max
atgggtactgacaagtcaaaccgggtcgggttagtgatatccagaactgacccgattcgggatttcctttccgacgcatcaaaagacgcgactctctccgacgaacttcaacgaacatcctccgatctgctcctccagtcggagataccctacgtgccatttcgcactgtgtggatggcctctgacccatcaaccagacccgacttgacccgactcttttcgggcacccgcttcatcttctccagccctaagcccagggaaaagagtgaagaattgaaggcgaggctgaaaaagttggaagatatagcggagaggaaagcgtatcaagagcttgtgaaggatattacgccgcctaaggatgttcaggaacccttctcttcttacaaggatcaattaggctttggtaaaaaaaaaaagtcacttcaatctcctacaacaactatgccagactcacatatatga

SEQ ID NO: 4395 - DNA, 648 bp, Glycine Max
atgggtactgacaagtcaaaccgggtcgggttagtgatatccagaactgacccgattcgggatttcctttccgacgcatcaaaagacgcgactctctccgacgaacttcaacgaacatcctccgatctgctcctccagtcggagataccctacgtgccatttcgcactgtgtggatggcctctgacccatcaaccagacccgacttgacccgactcttttcgggcacccgcttcatcttctccagccctaagcccagggaaaagagtgaagaattgaaggcgaggctgaaaaagttggaagatatagcggagaggaaagcgtatcaagagcttgtgaaggatattacgccgcctaaggatgttcaggaacccttctcttcttacaaggatcaattaggctttggtttgcatgttgtggttaccatgtttactggctatcttctcggatatgcagcatttagagcattgtttaatcacagtcctgccatgaatgccgctggaggaattcttgggttggttggtgccatgtttgttgaaactttccttttcattattagaagttccaatgcagatgccgacaaaacaagaaaatccagtcagaaaccgagatcatccttttcaacatccaggattaagaaaaaccagtag

SEQ ID NO: 4396 - DNA, 648 bp, Glycine Max; identical to SEQ ID NO: 4395

SEQ ID NO: 4397 - DNA, 1410 bp, Glycine Max
atgggtacttccaatcttctattgttcttctctctggtgagtctgtgtgctatggcggcttccaaggtggttcttattgggaataatatcactctctccttcgatgatattgaagctaattttgccccaacagtcaaaggttctggagaatatgggatcttatatttggcagaaccactggatgcatgtacagaattgacaaataaagttgaacaacttcccaatgcgagttcaccttttgctttggtggttagagggggatgtagctttgaggaaaaagtcagaagggcacaaaaggctggcttcaaagctgtaattgtctatgacaatgaagatggtggcatcttggttgcgatggcaggaaattctgctggtataaaaatacacgctgtatttgtatctaaagcttcaggtgaaatactaagcaaatatgctgggttgactaatgtggaaatatggctcattccaacttttgaaaactcagcgtggtctatcatggcaatttcatttatttccctgctagctatgtctgcggtgctggccacttgtttcttcgtccgcaggcatcgcataagaagagaaaggcctcgagctcctcttgttcgtgaatttcatggtatgagtagtcgcctagtgaaagcaatgccaagtttgatatttactgctgttttggaagataactgtacatcaagaacatgtgctatatgccttgaagactattgtgttggtgagaagctcaggattctgccctgctgtcacaagtttcatgctgcctgtgtggattcgtggcttacttcatggagaaccttttgtccagtttgcaagcgtgatgctagatccggcttaactgatccaccaccttcagaatccacacccttgctctcatcaaccccagcatctatggcatcgtctgtcttatcttctgcaagatcatcgctagcttcatcttcagccatacaaattgcccggacagcatctatggcatcctctgccttaccttctgcgagatcatccctagcttcctcttcggcaatacaaattgcccgggcagcttcacagaccccatctgtttctcgtaaccactccatagccagtacaccttatgttcagccatctcttaggtcctcctaccatcaatccccctccctaagtatcagccgaagctccgtagatcttaggaatgcatcccaaagatctctagcttctcacttgaattcaccacgttccatgggatacccgtctttgtcatctcttaactcgcggtacatgtctccacacattccaagtccaagcaatgcttcggtgagctatatgggctcatccagtcatcaacaacatcctctccgctatagtgagtcagctgcaagcttctccccatttgcatcgacacactcccttccggaatgttaa

SEQ ID NO: 4398 - DNA, 4350 bp, Glycine Max
atgggtagtgttgaaatccccaattggctgaaagggttgcccctggctccggaatttcgccctacagacactgaatttgccgacccaattgcttatatttcgaagattgagaaggaagctgccaactttgggatttgtaagattatcccaccgtttcccaaaccttcaaaaaaatacgttttttccaatttgaataggtcactcttgaagtgccctgattttggtccagataatagttcattaggtgtttgtaattcatcgaaaaccagttctggggatggtagtagtgacggggtgttgcgagccgtgtttactacaaggcatcaagaactggggcagagtcagagtgtgaaaaaagccaaagggacagttcagaatccactgtcaggtgttcataagcaagtatggcaaagtggggaggcttatactctggagcagtttgagtctaaatcgaagtcttttgcgaaaagtgtgctaggatcggtgaaggatgtttctcctctggttatagagtctatgttttggaaggcaactttagagaagcctatatatgtagagtatgcaaatgacgttcctgggtctgcttttgaagagtccaagggtcaatttcattatagtcatagaaggcaaaggaaaaggacttattataagaatacccaaaccgatgagaccaaggttgcttctgtccaaagtcattcggacacatgtttgcagatggccaaatcaagtacaactgaaaagagttcagatgccagcaatgaaatgcaaggcactgctggttggaagctttcaaacagtccttggaacttgcaagttattgcacgctcgtctggctcactaacacgttttatgcctgatgatattcctggtgtcacgtcacctatggtatacattggtatgctgttcagttggtttgcttggcatgtagaggatcatgagcttcacagcatgaattttcttcacactggctcatcaaagacctggtatgctgttcctggagattatgcctttgcttttgaggaagtcatccgcactgagggttatagtggtaacattgatcacttagctgctttgaaacttttgggtgagaaaacgactcttttatcacctgaggtaattgttgcatctgggattccttgttgcaggttaactcagcaccctggtgaatttgttgtgacttttccaagagcttatcatgtaggattcagccatggttttaactgtggggaagctgctaactttggaactccacaatggcttagagtagctaaggaagctgcagtacgcagagctgcaatgaactatcttcccatgctttcccatcagcaactgctttacttactgaccatgtcttttatttcaagagtgccaagaacactattacctggcgtgcgtagttctcgtctaagagaccgtcagaaagaagagagggagtttttagtaaaacaggcttttatagaagacatgctgcaggaaaacaagcttctatccattcttcttgggaaggaagcaactaaaaaagctgttttatggaatgctgatttactgcctgattccagcaaagattttcagttgcctgatttaacttctactactggatcctctatggcacatatgtcaaatattagttctgcagaaaagagtggtcattatctgcttgatgaaatgagtttgtatatggagaatttgactaatttagatcttggtggtgatgatcttccatgtcacttccaaactgattcaggagcattggcttgtgtgggttgtggaatccttggttttccatttatgactgtgatacaaccaaccgagaaattgataatggaacttcttcctgataatcatctagttcaagtttcctctccagactctactgcttgcgttcatagttccatctcaagggatctttctgtttccgaactttcatcagtaaaggagttgccagatcaatcattaaacaagtgcaataaatgttggaacacctccagtaagtttttgaggcctcggattttctgcctggagcatgctgttcaaatatttgagatgttgcagagcaaaggtggagccaatgtgcttataatttgccattcagactaccagaaaataaaggcacatgccagggcagttgcggaagagatacatagtgcttttgattataatgaggttccattagatactgcatccccagaaaatttgactttgatagatctggcaattgatggtgaagaacatgatgaatgtgaagactggacatctaaactaggcattaacctacggaattgtgtccatgcaagaaataactctccatctaaacaagttccttggatactagggacgctgttgtatgataaatgccttgcttcaaaatctttagctttaaattggcaatcacggagatctcgatcaaaaaggtcaagttgtttggctcagactaaaccgtgtgacagtattgagagaaagaaggaggatcggttttatggaagaatagatgactcccctgctgaaaagaagctacttcaatattcaagaaggaagttcaagtcaaagcaaaggtgtttccctgtagcaagcatggtcagtgaattccaagagaagtccaaaaatttgagtgattatgcattgtcatgtgtctctgcttctaccaaaatgtctccaatacatcctgaaatccagattgctgaaatgcctgctagcacgagattaaacgatgctaaaccgcaaccttccaattccattcctgatcatactttaatgactgaagaagttggagcagagattgagaagcaaaccatacaggaatcagatgtagacagaaataatgatttaacactcggtcattctaagatgcattgcaataccagtgtctcagaaatatgtggcaaggagagccaaggttgtcaggacaagaaatgttctagctcacttacaaatgcaactgatagaaatattgaaatgattagaatttctgaaattacagaagcaattatcatcgatagcaggtgtaatagcttaattttgaatggtgaagggcatcaagaatatcagtctacctgcaaaagcaacaatgaggaagctgctttatcacctgcttcattggtaaatcaatctaccctggcatctgtggttggaagttttggaagtccaaataataattatactgcagaaaaaattagcagtcctattttcctagaaaagacaactgaggaagaaattgattctttaagcgaaagggacaaggaacctctaattgatgacagaccaattagcgaacatactctaaaagaagtttacttgcataataccatagtcttggattatgagatgcaacatgaaactcagggtggaaaagatagcagaaaagaaataaatcagtcaactcttgtttcaacaattacaagaggggaatatgctgaagggttgaatgatgaagtgattccaaagtctgtggagcagtgccagattgaaaatatgaataaaattaatgtggaacctgtttctagctatgttgcaaaaggtgaaaataaatgtgtaacttcatcagaattaggatgttctgaagttttagtggaaacctatcctaaagactcctgtattcaattgatttcagataaagaaaaagaaacggaaatccagtcagaatgttctaaaattgagaaagagagctgtgttacagaaaacataaatggaatcaaagccaatttgtcaaaagataatagggagctggaaagctgcgagttgactacagcagttcccagatcaaatgccaggaagaataaaaagagaaaagtgaaaaatacaacgaagaatcaatccaatattgacaactttattagaagtccgtgtgaggggttgaggccaagagctgggaagattgccactgacaaaagtggggtggaaatcaaccaagttgacaaggaaaatcaggtggctaaaagggcaaggagatcttctgaaggtttggttcctcacaaaaataaaaaggatgatgttaaaaagccccataagtgtgaccttgatggttgccaaatgagtttcaagactaaggctgagttactactgcataaacgaaacctttgcccacatgaagggtgtggtaagaagttcagctcccacaaatatgctttacttcaccagcgtgttcatgatgatgagaggccccttaagtgcccatggaaaggttgttccatgtcattcaagtgggcttgggcaaggacagagcatattcgcgtacatactggggagaagccttatcactgcaaggtcgagggatgtggcctttctttcaggtttgtatcagattttagcaggcacagacggaaaacggggcaccatgtgaaacctcctgcttga

SEQ ID NO: 4399 - DNA, 2172 bp, Glycine Max
atgggtattccgcagagggagaggaaaatggaagggtggctctatctcattcgcgccaatcggtttggtcagcattattcacgtaagaggtacttcatcctcaaaggcaatgccctccgaagcttcaagatcaaacccacttctcaaatggaggagccaattaggagtgcaataatagactcctgcattcgggttaatgacaatggaagggagactatgaacaaaaacgtgttgtttattttcactgtatataatgccacagatcaaagtgataagcttaagaatgtctctcattataagaaacttaattttttttttctttttcaggggtgcccaagtccagcaaagaatttagtggcttgtcacaagaaaaggcgttcaagtttgagaaacggaggctcaaaaagcacagattggaaatactccaacttgaattttcaatcgtgcatatacactgaagcaatgaccgctgatgttattgctccttcaccatggaagatttttggttgtcagaatgggctaagaatgttcaaagaagccaaagattgggattcccgtggaagtcattgggtgggtgaaaacccagcaataatggcagttggtgtggttgatggagcttcagaggccatcttccatactcttatgactcttgatccctcaagatcagaatgggacttttgtatttaccgaggcaatgtggttgatcacattgatggtcatacagatattattcatttgcagctgtacaatgattggttaccatggggaatgaaaccaagagatttgttgttacgaagatactggaggagggaggatgatggatcatatgtgttattattccattctgtgtaccattccaagtgtccacccaagaaaggctatgtccgagcttgcgttaaaagtggaggatttgtagtgactcctgttaacaaaggaacacagtccgttgtgaggcacatgcttgctgtagattggaagttttggaaattgtatttgcgccccgcatcagcaagatccataaccattcgtatgcttgaacgaattgcagcactaagagagttgtttagaacaaaaggaggaaactactcctctgaacctcttgcaatgacaaaagatatagggttgcctcttggtgtaaaggaggatattaagactgaagtttcacaagagaaaaacaagtttgaggaaccacctcttgttgtcatggaagatgaagtagaaccttctggccgtagaagtttaatggggttgaatgattctgatgagttctttgatgttcctgaaccaacggagtatgatcactttcagaatgagtggcatgctgacttgtcttcagaacagatgagtatgtccatccccagaatgacatcagctgctggtttcgttaaaaaattgcacggccttgcagttcagaaaaaggggtatatggatttgcaagaagctgcaatggaggaaagtacatcatgctcttatggagccactctccaaaaggattcaagttgtgcttcaccctgcacctgggctgcttctgatccatctttgtttttggttcgaggagaaaattatttacaagaccatcagaaggtgaaggcaaatggcaccttgacgcaaatggttggtgcagattggcttcgttctgacacaagagaagataacttgagtagtcgtcctggttccatagttcagcaatatgcagcaaaaggtggtccagaattcttttttgttatcaacatgcaaatgcccggaagtcctatgtattcccttgcactctattacatgttgaaaactcctttggaagacaatcccttgttgcagagctttgtggatggagatgatgcttataggaactcaagatttaagctgataccatatatatctaagggatcatggatagtaaagcaaagtgttggaaagaaagcatgtttggtgggacaagcgctagaaatgctttatatccgtgggaagaactatctagagattgatatcgacgttggatcttcaaccgtggcaagaggggtggctagcctagttcttggatacctgaacaatctggtggtagaaatggcatttttggtacagggtagcacaccagatgagctcccagaagttctccttggaacatgtagactaaatcatatggatgcatccaaagcatttctggtgaattcataa

SEQ ID NO: 4400 - DNA, 1683 bp, Glycine Max
atgggtgaggcttcaggagctggttctgctgattgtttcagccagatgatgtcgtcgatgccgggttttcgcttccatcccacggatgaggagttggtgatgtactatctgaagcggaagatttgtgggaagaggctgaagctcgacgtgattcgtgaaaccgatgtgtataagtgggatcctgaggatttgcctgggcaatctatattgaaaactggagataggcaatggttctttttctgtcacagagataggaagtatcctaatggtggaaggtctaaccgagcaaccagacgtgggtattggaaagcaacgggaaaggatcgtaacgtgatatgcaattctaggtcagttggagtgaaaaagaccctggttttctatgctggcagagctcctagtggtgagcggactgattgggttatgcatgaatataccttggatgaagaggagcttaagagatgcctgggtgttaaggactattatgcactttacaaggtttacaagaaaagtggacctggtccaaaaaatggtgaacagtatggcgcaccatttaatgaagaacagtgggcagatgatgacatagtagattttaatatcaactcagctgatcaggaggctccaaatgatgttgataatggtaatgtactgcagcctttgcttgatgatgaaatcgacaacatcattaggggaattttggatgatgagcttgtccttgatcagcagcatgtgaatggttatcctgactttcctcaggttgttagtgaagaaacacaaagtactgttgtggatcagttctctgaggctgtgatgttccctgagccagtcagaatcacacagcctagcaaccaattttttgatgcacagcctagctttgacttcaatcagccagttacttctcatttgcatgtttctgaagcatctgaggtcacttctgcttccagcattaaagcaaaggagcttgattttaatgaggatggcttcttggaaattaatgatctcattgatactgaacctatattggcaaatatggaaaatcctgtggagtaccagcagtttgaagatgggttaagtgaacttgatctgttccaagatgcacagatgtttcttcgtgacctggggccaattattcacgaaacagattcacatgcatatacaaatgcatttgtcagcagcaatattgaaagtcaaagttaccagttgctgccaaatccagaggatgccaatcaaactgtcggtgaattctggatgcacggtgaaagaaacaccccaagtgcatcagaaggctttgttgattctttctcgctatcatccccaggtgttgtatatgaatctgttggctttcctacggaaggcaataacaatcaaagtagcactgtggaagatgttgctacaagtagcttctcctctgctctctgggcctttgttgagtcaatacctacaactcctgcatcagctgctgaaagtgctttggtgaaccgagcattgaatcgaatgtctagcttcagcaggttgaagatcaagcacacaaacattgctgcagcaggtaaagacactgcaactatgaagagagcaggcagaaagggacttccattccttttcttccctattattattgctttatgtgctttttgttgggtttttgttggaaacttaagactattggggagatgtgtctctccttga

SEQ ID NO: 4401 - DNA, 1200 bp, Glycine Max
atgggtgcaacgacggccattgccgcactctctcttcactgcttctccaaatcccacacacacttttcaccctttcgcactctccctcgcctcacatgctccttctcttcctccatcaaattcaacatctccttcgctccccctaagcccaagcccaagcccgaacccgacgcctcaaacgagcccgacgggccgctcctcatcccgtggatcgtccggggcgaggacggcaacctcaggctccaatcagaacctcccccgagcctcctcaatgccatcgccaccgcccaaaccggaaccaaaaaggacaataagcaaaccaaaaccaccgccgccaccgccaccaacaccactaaacctcaaaaggctcgctccacagcgccgccgcagcattcgaaggcggcgcggcggttctataaccaaaacatcaaggaatcctccgccgcgcgcctcagcaaggttctcgccgcctccggagttgcgtccaggagaagctgcgaagagcttatcttcgaagggaaggttacggtgaatggtaccgtgtgtaatacgcctcagactaaagttgatcctgcgaaggatgttatctatgtgaacgggaacaggcttccgaagaggcagcctcagaaggtttatctggcattgaacaaacccaaagggtatatatgttcatctggggagaacgagtctaaatctgtgataagtttatttgatgattacttgaacagttggggtaaaaagcatccgggagtacccacaccacggttatttactgtagggcgccttgacgttgctaccactgggttaattattgtgactaatgatggagattttgctcaaaagctttcgcatccttcatcaaatttatcaaaagaatacattgcaacaattgatggtttagttcacaagaggcacttaatagccataagcgagggaactactgttgagggtgtcctttgtgtgcctgatgttgtggagttacttccacgtcagccagagatgcaaagaactcgaattcgcattgtggttcatgaaggtaggaaacatgaagttcgtgaactcgtcaaaagagctggacttgagattcattcattaaagcgagtacgcattggtgggtttagacttccaccagaccttgggttaggaaagtatattgagttaaataaaacgaatctcaacgcattggggtggaagagctaa

SEQ ID NO: 4402 - DNA, 1137 bp, Glycine Max
atgggtgcaacgacggccattgccgcactctctcttcactgcttctccaaatcccacacacacttttcaccctttcgcactctccctcgcctcacatgctccttctcttcctccatcaaattcaacatctccttcgctccccctaagcccaagcccaagcccgaacccgacgcctcaaacgagcccgacgggccgctcctcatcccgtggatcgtccggggcgaggacggcaacctcaggctccaatcagaacctcccccgagcctcctcaatgccatcgccaccgcccaaaccggaaccaaaaaggacaataagcaaaccaaaaccaccgccgccaccgccaccaacaccactaaacctcaaaaggctcgctccacagcgccgccgcagcattcgaaggcggcgcggcggttctataaccaaaacatcaaggaatcctccgccgcgcgcctcagcaaggttctcgccgcctccggagttgcgtccaggagaagctgcgaagagcttatcttcgaagggaaggttacggtgaatggtaccgtgtgtaatacgcctcagactaaagttgatcctgcgaaggatgttatctatgtgaacgggaacaggcttccgaagaggcagcctcagaaggtttatctggcattgaacaaacccaaagggtatatatgttcatctggggagaacgagtctaaatctgtgataagtttatttgatgattacttgaacagttggggtaaaaagcatccgggagtacccacaccacggttatttactgtagggcgccttgacgttgctaccactgggttaattattgtgactaatgatggagattttgctcaaaagctttcgcatccttcatcaaatttatcaaaagaatacattgcaacaattgatggtttagttcacaagaggcacttaatagccataagcgagggaactactgttgagggtgtcctttgtgtgcctgatgttgtggagttacttccacgtcagccagagatgcaaagaactcgaattcgcattgtggttcatgaaggtaggaaacatgaagttcgtgaactcgtcaaaagagctggacttgagattcattcattaaagcgagtacgcattgtgcacactactttccggagtgtttaa

SEQ ID NO: 4403 - DNA, 1899 bp, Glycine Max
atgggtgggagcgagagctcgaagggtgtggttatgagtcgtttggttgagtgcatcaaggagatttctgggttgccagagagtcagaacttgtgcaagaaggtgtatgggaatttggttcgcagggtgaagcttttgagtcctctctttgaggaattgaaggataatagtgatgagtccctcagcgatgaacaacttcaaagctttgactctctctttgttgctttgggttcagctaagacccttttaaaggatgtgaaccaagggagtaagctttatcaggctttgcggaggaatgatacagcagataagttccaaaaagtaactgaaaaaattgaagctgtgctcagtgaaattccttacaataaacttgacatatcggatgaagttcgagaacagattgaactggtgcatgctcaattcaaaagagccaaagctcaaacagaatttgctgatatacaactagacctggatatggcagtggcacaaaaagaaaaggaccctggtcctgctgtactgaagagactttctgaaaagttgcatctaaggacaataaatgacctaaggaaagagtctagtgaattgcatgaattgttcatcacaagtggtggagaactcggcgattcttttgaaatgatcacatcccttctcagcaaactgagggaatgtgtgctcacagaaaatcctgaagttgattccagtgaatgtgaaaaattgtcagttaagcacaggtctcccatgatcccagatgattttcgatgtcctatatctcttgaactaatgaaagatcctgtaattgtctccactggtcagacatatgaaagatcttgcattcaaaaatggcttgatgctggtcacaaaacctgccccaagacacagcagacacttgtgcatacagcccttacccctaactatgttttgaagagtttgattgctttgtggtgtgaaagcaacggtattgagctaccaaagaaacaagggaactgtagaacaaagaaatgtggtggcagcagtctttcagattgtgatcgaactgctattagtgctttattggataaactaacgagtaacgatatagaacagcaaagggcagctgctggtgagctccggttgctggctaaaaggaatgcagacaaccgagtatgcattgctgaggcaggagcaataccacctcttgtagatctgttgtcttcttcagaccctcgaactcaggagcatgctgttacagcgcttctcaatctttccatcaacgagagtaacaaaggaactatagtaaatgctggagccataccggatattgtagatgtactgaaaaatggcagcatggaggctagagaaaatgcagctgcaactctctttagtttatcggttctagacgagaacaaggtgcaaataggtgcagctggagctatccctgctctaataaagttactttgtgaaggtactcctagaggtaagaaggatgctgctactgctatcttcaacctatctatttatcagggaaataaagcaagagctgtaaaagctggtatagtagccccactgatacaatttctgacggatgctgggggtggaatggtagatgaagcactagctattatggcaatccttgcaagccaccatgaaggcagggtagcgatcggtcaggccgagccaattcatattcttgttgaggttatacgaaccggctctccacgcaatcgagagaatgctgctgctgtcttgtggtcactatgcaccggagatccactgcaattaaaactagcgaaagaacatggtgcagaagcagcactgcaggagttgtcagaaaatggaactgatagagctaagagaaaagctggaagcatattggaactcttgcagcgaatggaaggggttgataatctgcagagttcatag

SEQ ID NO: 4404 - DNA, 2121 bp, Glycine Max
atgggtggtatttgctcgaggtcatggaaagcgactgtggatggtgtagctgtagataatgcacttagtggaagctcgaggcatgctaatggtcatcctattgtacttcccagaaatgatgatgatgttgatgatgatgacgacttggataagcatcaacgagaatcgttttcgtttaccagaagggaaaatgtttttaatggatcgggtatggatgatatcaatgatgggattcctcgcctgcccagggctttatcacataaatctagagagaaaagagggaaggcacagttggggagattgggggaggagaggacaagatactattcaaaaaaggaaagcatattacaggataataatctagaatgcaacaaaactgactgcggattagaaatggaaactctcttgaaaaagccaagggtaaagcaccttagtgaagccataaacaaaagctcaaagcatatttatttgcatagggatacccttaaaaatgtatcagaggtgagttcacttttgggccgagctggtacagctgggcttggcaaggcagtagaagttttggacacactaggcagtagtatgacaaatttaaatctcagtaatggttttacatcaggtgtgacaacaaaaggaaataaaatttccattttggccttcgaagttgcaaacacaattgttaagggcgccaatttgatgcaatctctttcgaaagagaacatcagacatttaaaagaggtggttctaccatctgaaggagtgcaaattttgatatccagagatatggatgaactcctaagaattgctgcagcagacaagagagaagaattgaaaatattttctggtgaagttgtgcgttttggaaatcgttgtaaagatcctcaatggcacaacctggatcgctattttgagaagttaggttcagagcttacaccacaaaaacaattgaaagaggaggcagagatggtgatgcaacaactaatgacctttgttcaatatacagctgaattatatcatgaattgcatgccttagatagatttgatcaagattatcggcgcaagtttcaagaagaggacaattcaaatgccacacaaagaggagacagccttgcaattttaagagcagaattgaagagtcaaaagaagcatgtaagaaatttgaagaaaaaatcactatggtccaagattttggaagaggtgatggaaaagcttgtagacatcgtccattttctatacttggagatacatgaagcatttggtagttctgatactgataagcaagcgaaagattctcaaggcaaccataagaagttgggatctgctggtcttgctttgcattatgcgaacattatcactcaaattgatactctcgtgtctcgatcaagttctgtgcctcctaatacaagggatgctttatatcaagggcttccacctaatgtaaaatcagcattgcgctcgaggttacagtcatttcaggttaaagaagagcttaccgtgccacaaatcaaagctgaaatggagaaaatattgcaatggcttgttcctattgccgccaatacaacaaaagctcatcatggctttggatgggttggagaatgggctaatacagggtctgagttcaaccgaaaacctgccggccagaccgacttgttgaaaattgaaacactacaccatgctgacaaagacaaaacagaagcttatatacttgaactggtcatttggcttcatcatctagtgagccaagtaagagttggtaatggaggaataaggtccccagtcaaatcgcccatccgttctcctacccaaaagacagggcagttatttacacagaaagcctgctcttcccccatgttaacggttgaagatcaacaaatgcttcgcgacgtcagcaagaggaaactaacacctggcattagcaagagccaagaatttgacactgccaagaccaggttgagtaaacaccataggctaagcaagagtagtagtcattccccaatcagtgaaagtaaaaatgatatattctctacaaggaggttaccttctgttcctgtcatcgactttgatatcgatcggatgaaggccttggatgtcattgatagggtggataccattggaagttcatag

SEQ ID NO: 4405 - DNA, 855 bp, Glycine Max
atgggtggttccgttttcactcacttcctcgttctcccctcctcttctactccttctctttccactctcttcccatccaaattccccaccagacccatcaatgaatcttttcccttcacccttacctgcaaccaattcccttccaaactcactacttcgcggccttcccaattctcagctcctcctagttactcatgctctgtaaaaaagataaaagcttcgggaagtcagcaaacaggatccattcgacatggagacaaccttgatgcaatgaatagcaggagtttgctgcagaagtttcagaggaaaatgccaacggtattccttttcaacaagcaatctatgaggagtgggactttctttgtgattcgccaagttcttgtccgcagagaactcgacctatctgccaaagagttgcaggagcaagtaagaagtggtgatgctggtgcaactgagctttttgaacttggtgcagtgatgctgcgcaggaaattttaccctgctgctaccaagttcttgcttcaagcaattgagaaatgggatggggataatccggatcttgcccaggtttacaacgctcttggtgtgagctatgtccgcgatgggaaagttgacaaaggaattgctcaatttgagacagctgtcaagcttcaaccaggctatgtcacagcttggaacaatctcggtgatgcctttgagagtaaaaaagactacaagtctgctctgaaggcatttgaagaagtcctactgtttgatcctaacaacaaggttgcccggcctagaagagattctttgaagggacttgttgatgcaaccaaaggagttactgtcatcaagtcaacagagaagaaatga

SEQ ID NO: 4406 - DNA, 1065 bp, Glycine Max
atgggtggttccgttttcactcacttcctcgttctcccctcctcttctactccttctctttccactctcttcccatccaaattccccaccagacccatcaatgaatcttttcccttcacccttacctgcaaccaattcccttccaaactcactacttcgcggccttcccaattctcagctcctcctagttactcatgctctgtaaaaaagataaaagcttcgggaagtcagcaaacaggatccattcgacatggagacaaccttgatgcaatgaatagcaggagtttgctgcagaagtttcagaggaaaatgccaacggtattccttttcaacaagcaatctatgatgagtgactttacaaccaaagatattgatgacagggaaagatcatccaaatgggtttcagcattcctctttggacaaactatatcagtgatttctcctgatgtttcatgtgcaagcagctcagcaagaataaatgagatatatgaggttggagagttgtttgatttaagcatccaactaatatacttgatattgctattgggtttgctagggagtgggactttctttgtgattcgccaagttcttgtccgcagagaactcgacctatctgccaaagagttgcaggagcaagtaagaagtggtgatgctggtgcaactgagctttttgaacttggtgcagtgatgctgcgcaggaaattttaccctgctgctaccaagttcttgcttcaagcaattgagaaatgggatggggataatccggatcttgcccaggtttacaacgctcttggtgtgagctatgtccgcgatgggaaagttgacaaaggaattgctcaatttgagacagctgtcaagcttcaaccaggctatgtcacagcttggaacaatctcggtgatgcctttgagagtaaaaaagactacaagtctgctctgaaggcatttgaagaagtcctactgtttgatcctaacaacaaggttgcccggcctagaagagattctttgaagggacttgttgatgcaaccaaaggagttactgtcatcaagtcaacagagaagaaatga

SEQ ID NO: 4407 - DNA, 1041 bp, Glycine Max
atgggtggttccgttttcactcacttcctcgttctcccctcctcttctactccttctctttccactctcttcccatccaaattccccaccagacccatcaatgaatcttttcccttcacccttacctgcaaccaattcccttccaaactcactacttcgcggccttcccaattctcagctcctcctagttactcatgctctgtaaaaaagataaaagcttcgggaagtcagcaaacaggatccattcgacatggagacaaccttgatgcaatgaatagcaggagtttgctgcagacagaagtttcagaggaaaatgccaacgtgagtgactttacaaccaaagatattgatgacagggaaagatcatccaaatgggtttcagcattcctctttggacaaactatatcagtgatttctcctgatgtttcatgtgcaagcagctcagcaagaataaatgagatatatgaggttggagagttgtttgatttaagcatccaactaatatacttgatattgctattgggtttgctagggagtgggactttctttgtgattcgccaagttcttgtccgcagagaactcgacctatctgccaaagagttgcaggagcaagtaagaagtggtgatgctggtgcaactgagctttttgaacttggtgcagtgatgctgcgcaggaaattttaccctgctgctaccaagttcttgcttcaagcaattgagaaatgggatggggataatccggatcttgcccaggtttacaacgctcttggtgtgagctatgtccgcgatgggaaagttgacaaaggaattgctcaatttgagacagctgtcaagcttcaaccaggctatgtcacagcttggaacaatctcggtgatgcctttgagagtaaaaaagactacaagtctgctctgaaggcatttgaagaagtcctactgtttgatcctaacaacaaggttgcccggcctagaagagattctttgaagggacttgttgatgcaaccaaaggagttactgtcatcaagtcaacagagaagaaatga

SEQ ID NO: 4408 - DNA, 501 bp, Glycine Max
atgggttgcggctcctcccttccagataggggctcaaggcagttgggtcgacccaattcagagaatggtggagggcaggacgccaagaatctgagggtcaagcttgttctcttaggtgattctggtgttggtaaaagctgtattgttctacgatttgttcgtggtcagtttgatccaacatctaaggtaactgttggagcttcttttttgtcgcaaacaatagctctgcaagactctacaacagtcaagtttgaaatatgggatactgctggtcaagagaggtatgctgcgttagcaccgctatattaccgtggtgcagcagttgcagttattgtttatgatataacaagcccagaatctttcagcaaagcacagtactgggttaaggagctacaaaaacatggaagccctgatatagtgatggcactggtcggtaataaagctgatcttcttgagaagcgggaagttgctgtccagagaagaatggtatgtttttcatag

SEQ ID NO: 4409 - DNA, 597 bp, Glycine Max
atgggttgcggctcctcccttccagataggggctcaaggcagttgggtcgacccaattcagagaatggtggagggcaggacgccaagaatctgagggtcaagcttgttctcttaggtgattctggtgttggtaaaagctgtattgttctacgatttgttcgtggtcagtttgatccaacatctaaggtaactgttggagcttcttttttgtcgcaaacaatagctctgcaagactctacaacagtcaagtttgaaatatgggatactgctggtcaagagaggtatgctgcgttagcaccgctatattaccgtggtgcagcagttgcagttattgtttatgatataacaagcccagaatctttcagcaaagcacagtactgggttaaggagctacaaaaacatggaagccctgatatagtgatggcactggtcggtaataaagctgatcttcttgagaagcgggaagttgctgtccaggatggcactgactatgcagagaagaatggtatgtttttcatagagacatctgcaaagacagcagataatataaatgaactgtttgagaatgagaatgtacgaacaatggaaaatagttag

SEQ ID NO: 4410 - DNA, 603 bp, Glycine Max
atgggttgcggctcctcccttccagataggggctcaaggcagttgggtcgacccaattcagagaatggtggagggcaggacgccaagaatctgagggtcaagcttgttctcttaggtgattctggtgttggtaaaagctgtattgttctacgatttgttcgtggtcagtttgatccaacatctaaggtaactgttggagcttcttttttgtcgcaaacaatagctctgcaagactctacaacagtcaagtttgaaatatgggatactgctggtcaagagaggtatgctgcgttagcaccgctatattaccgtggtgcagcagttgcagttattgtttatgatataacaagcccagaatctttcagcaaagcacagtactgggttaaggagctacaaaaacatggaagccctgatatagtgatggcactggtcggtaataaagctgatcttcttgagaagcgggaagttgctgtccaggatggcactgactatgcagagaagaatggtatgtttttcatagagacatctgcaaagacagcagataatataaatgaactgtttgaggaaattgccaaaagactgcctcgcccatcagttagttga

SEQ ID NO: 4411 - DNA, 1125 bp, Glycine Max
atggtatcccaacgagacgaatatcactactgttttattagtctcagtctcgttctcacttctcactcacgtaaaaaacacttccttttttcacaacctaatctaacccttatgaaggggtttaacacagtttgttgggcaatgtacacgagttgttcttgttcacaccaaatgatgctgtttgtttcattgtgctgttattttggttggtactgtttaaaggggcctgtggtttttactgatgctgttacatggttttgtgaggattgtgcaacaaagcttggggtgccacctgctcttgaccaatctacacctatctcatctgtatcaagaaacaattgcattcagagagtgaaaaaacacaataaacagcgaaaaaagaagcttaaaaagaagcagaagaaaggaaaagctaactctagcttagttgctaaaacaaaggaagtgttatctggttgtcacatttcacctgagcctgagcatcctcaatgtagtaacagaggtgaagaatgtgagatgaaagatgaatgtggaccagctccaagggatgtagctaattttgatgtagtttctcaaggagctaccgataatgattcaggttgtgtagaattagatggtcatgtttatgcacaccctactattgatccaatctggaggtacataaactgttttgctaacttcattggaaattggggaagtatgtacttctgcaatgaaactaatggtactgtcaatggagttctggctcatatgtccaatttagcgtgctccaaagttgcggaggagacaggacatttcccagaagtgcttcatgctgaattgcttcccagagataaggtgtggcctgaaagtttcaagagtaggaggccaactgatcaggacattgctctttttatctttccagacactgaaggatctgaaaaggactttgataagctggttgaagatatcatgatcaatgagcatgtcataagaattgtggctaaaaaagcagagcttttaatttttcattctatcgagcttccaatccaatattggagatttgaagccaagtattatttgtggggtgtcttcagaagaaagcaaacttcagaagagacaaatgatgctgtgtacagagattga

SEQ ID NO: 4412 - DNA, 978 bp, Glycine Max
atggtgcacccaatagcagaggcaaacgaggaaagtccgttcgggaaactaacgccggaagagttctacgcgcatcactcagtgagtcacggttccgagttcgtgacgaaccctagaggtctcaagctcttcacacagtggtggaccccactccctccaaaaaccatcattggaaccctcgccgtcgtgcacggatacaccggcgagtccagctggctcctccagctcaccgccgtccacttcgccaaggccggtttcgccacctgcgccctcgaccaccagggccatggcttctccgacggcctcgtcgctcacatccccgacatcaaccccgtcgtcgacgactgcatcaccttcttcgagaatttccgttctcgcttcgatccctcgcttccttcgtttctctacgccgaatccctcggcggcgcaatcgcgcttttaatcactctccgccgccgcgaaatgctgtggagcggcgttattctcaacggcgccatgtgcgggatcagcgccaagttcaagccgccgtggccgctcgagcacttcctctccgtcgtcgccgcggtcatcccgacgtggcgcgtggttcccacgcgcggctccatccccgaggtgtcgttcaaggttgagtggaagcggaggctggcgctggcgagcccgcggaggacggtggcgcgtccacgagccgccaccgcgcaggagctgcttcggatctgccgggagcttcaggggaggtacgaggaggtggaggtgccgctgctggtggcgcacggcggcgacgacgtggtgtgcgaccccgcgtgcgtggaggagttgcacgcacgcgccgcgagtaaggataagacgctgaagatatatcccgggatgtggcatcagatggttggggaacccgaagagaacgtggagctagtgtttggggacatgttggagtggcttcgtacacgcgctcaacgcgcccccgagcacggtgttgcttag

SEQ ID NO: 4413 - DNA, 2367 bp, Glycine Max
atggtgtcagggagcgacccagttgagtcttttttcaattccgttcaagttgtgaaggattcgctgtcgccacttgaagtgggtattcgcaaggcggcgaaggatcttgagcattgtttggcagggtcaaagaacaaggtaaacaatggtgtttgtttgattgccccagtgagggaaagtggtgcatttcagatctgtgatgtgaagaagaagaaaggtttgtcaatgaaggttcccttgaaggctttctggggcatgttttcacagaattcagggaatggtaatggtaatggtagtagtaatattagagctcaagtgggcaaggaagatggaccctcttgcaccaattgcttgcagtttgctgtgacttggtctttgttggttaatggattccttcagtctctgccacttcctttcaaatctgggaagaagaagtgtcagaaagtgtgtgatgaagacaagctagcagttagggagaagggtgtgaggaagaaggatgggaaaaatgtttcacttgagtgccttataggttttatctttgatcagctatctcagactcttcagagtcttgatcatcatggggtgcaagataataatgatgaccttgacaatgggaaaactagtctgccccaaccttctttttctcattttggtcatgtgaatgcactcgcaggtttcttggaggagcacaaagtatatgtgaatagcttcttggggaatttgaggtttgcaaaggtgggtggtgtgccatcaagtgtgcctggagaagaaagcccttcaactaacggagagggagatattagtagtgacaatggtaatggtaataatgaaaacaaggatgaaaccggaggaaattcgccgcagaaggttgccaacaacatattcagtattcctctctcgaatgtggagcgtctaaagtcgacactttccacagtttcattgacagaattgattgaactgctaccgcagctggggagaacatctaaagaccatcctgataagaagaaactaatctcggtacaagatttctttagatacacagaagctgaagggaggaggttctttgaggagttggatagagatggggatggccaagtaactctggaagatctagaagttgcaatgagaaaaagaaagctgccacgaagatatgctaaagaatttatgagccgtgctagaagtcacttattttccaggtcttttggttggaagcagttcttatcattaatggaacagaaggagccaacaattcttcgtgcatatacttctctatgtctaagcaagtcagggacactgaagaaaagtgaaatattggaatcactaaagaatgcaggactccctgcaaatgaagacaatgctgttgctatgatgcgatttctgaaagcagatacagaagaatctatttcatatggacatttccgcaatttcatgcttctacttccctccgatcgtcttcaagaagatcctaggagtatttggtttgaagctgcgacagtagttgctgttccaccagctgttgaaattcctgctggaagcgttctgagatctgcattggcaggtggcctttcttgtgccctgtcatgtgcgttactgcatccagttgataccattaagactcgagtacaagcatcaacaatgtccttccctgaaataatttctaagctgccagagattggaaggcggggtttatacaggggctcaatccctgcaattcttggacagttttcgagccatggcttgcgaactgggatatttgaagcaagtaaattggtgttgataaatgttgctcctacactgccagaactccaggtacaatctgtggcatcattctgtagcacatttttgggaacagctgtgcggatcccctgtgaagtgttgaagcagaggttacaggctggtctttttgacaatgtgggtgaggcttttgttgcgacttgggagcaggatggtcttaggggtttcttccgtggaaccggagctaccttgtgccgtgaggttccattttatgttgctggcatggggctttatgctgaatctaaaaaggttgcagaacgactactagagcgggaactcggtcccttggaaacaattgctgttggagctttatctggtggcttggcggctgttgttacaacgccgtttgatgtcatgaaaactagaatgatgactgcacagggccgatctgtgtcaatgaccttgatagccttctccatactaaaacatgagggaccccttggcttgttcaaaggagcagtacccaggttcttttggattgctcctctaggtgctatgaactttgcaggttatgagttagcaaagaaggccatgaataaaaatgaggagggcaaggcaggcagttcagagtaa

SEQ ID NO: 4414 - DNA, 882 bp, Glycine Max
atggtgtgtgagaggcaaagatgtaattttttgaacaagtttggtgaattgggaaatgggtttcttgctgtgagtgagggtggtttggagttggataaaggtgggatttttagttttttaatgattgggaagggtatatgtgaagctgtggttgctttgcatttggaagggttggttgctggctgtttggggctttcttgtttctcttttgatgagcttggtgggatttgtgttgatttgaatgaggcattgatgctggcaaggaagtttgtgaatgttgtttccgttgaacacgaagaagaagcaatgtgtaaggattgcttggaaaatgaggtttttgcaagccctgaggttttgtatgggttgttgcacaagaggggcactgctccggatagtgggcattcgagatatccaactgggtatggctcggatgtatggtcattggcttgtgtactgctgcggcttcttattggaaatgcgctgccttggaataccttggaaatgaaggaagagaatgacggtgatagctctgctagttatgcatgctgggtggagaaagttagttctgttttggaagacaaactaggctctgaatatctgtcactaaggcagattctttgtaaatgtttggatgtcaatccaggaaaccggccagatgtggtggatgatatgttagtcaaaccgcaatttgattttctgggcaacttggaggtcacggtaagtagggactacacgggtctttgcttggttctaggggagttgtgtttgttgcctaagcaaagttctaatgaactgattgaacatgagttgtgggagaaagaaattggtggtcaaccaaatgttgttcaagatggcaaaggcaaatttgatgaagaagaataa

SEQ ID NO: 4415 - DNA, 2094 bp, Glycine Max
atggttgcctttgggaaaaagttgaaagaaagacaaattcaagaatggcaaggatattacataaactacaaactaatgaagaaacgagtaaaacagtatgctcaacaaattcaacttggaacactagatcggcgccatgtacttaaggatttctcaagaatgctggataatcagattgagaagactgtgcttttcctgttggaacaacaagggcttttggcaagtaggatagcgaagctcggagaggagcatgaagttattcagcaggagcctcatataagtagaatagctgaactacgagaagcttatagagcagtgggacaagagctattgaagcttctcttctttgtagaagtcaatgctgttggtttgcgcaagatattgaagaagtttgacaaacgctttggctataaatttactgattactatgtcaaaactcgcgcaaatcatccttactcccagctgcaacaagtgttcaagcatgtgggatttggagctgttgtgggagctttatctcgcaaccttcacgaacttcaggagaatcaggagagtcagggaagcttcttatcaatttatgatcagcctacacttcccctccaggatcctgttattgattcaataagagcagctattgataggttaagtaactcaaccaacttcctaaactttttggggcaacatgcacttattatgcatgaggagttgcctgcacctgttgatgagcgtgttgacgagcaaagttaccattttatgtctcttttcctgaacttggcaaacacatttttgtacatggtcaacacatatattatagtccctacagcagatgattattctatgagccttggggctgcaccaacggtttgcggtattgtgatcggggcaatggcagttgcacaggtgttttcttcggtgtattttagtgcgtggtcaaatagatcatacttgaggcctcttatattcagtagcatagttctttttctcggcaatgtcttgtatgccttggcatacgatcttaattcgatatggattctcataattggtcgtcttttatgtggatttggttctgccagagcggttaaccggcgttatattagtgattgtgtgcctttaaagatccgcatgcaagcatcggcaggtttcgttagtgccagcgctcttggaatggcctgtggtcctgcattagccggcttacttcagaccaattttaagattttcaacattacatttaaccaagataccttaccagggtggcttatgactattgcttggctgatatacctagtgtggttgtggatcacttttaaggaaccttatcgtgaaattgaagagaaacatgtaccacatcaatccaatgctgaaaacaatgcacttgaaaaaggcataaaacaaccactgctgactagtttaaaagataaggtagatgaagatgatgatcaggattacgaagatagtgaagaagctccagaggattctcatcagccagccaattcaattggagcagcatatagactccttacaccttctgtaaaggttcagttattgatatacttcatgcttaaatatgcaatggagattttactatcagaatctagtgtcatcacaacatactacttcaattggacaacaagcactgtttccatttttcttgcttgccttggtttgacagttcttcctgtcaacattattgttggaagttatataagcaatatgtttgaggacaggcaaattttgttggcatcagaaattatggttttcttaggcatacttttcagcttcaatgtaatttttccatacactgaaccacagtacatctgttcggggctccttatgtttgtttctgctgaagtacttgaaggtgtcaacttgtcacttctttcacgagtaatgtcatcaaggctttctcgtggaacctacaatggagggctcttgtctacagaggcagggacacttgcacgagtcattgcagatgcaaccattactcttgctggctatgggggtgtgagtaggctccttaacgtcacccttcttccttccttcttcatttgcgtaggttccataattgcaacttgctatacctacaattctttatattga

SEQ ID NO: 4416 - DNA, 936 bp, Glycine Max
atggttggacctaacttcatggatgagatagactgcggcagcttctttgaccacatcgacgaccttctcgattttcccgtcgaggacgtcgacggcggcgctgccaccttgccttccgtctccgccggaaacagcaactcgctggcgagcatctggccctccgagtccgactcgtttcccgcctccgactcggtgttttccggcaacagtgcttcggacctctcggccgagctatccgttccgtatgaagacattgtccaattggaatggttgtccaactttgtggaggattccttttgtggggggagcctaacaatgaacaaagtggaagagccatcatgtaccactaaggaggactcggtcaacacccaatttcacacatcaagcccagtttctgtcctcgaaagtagcagttcttgctctggtggcaagactttgccacctcgcagtccagagatttacatccctgtgccgtgtggacgtgcacgcagcaagcgtccacattctgagaattttgctgagtctcaacttgttcccaagatgccgaagctagcttctggggagcctaagaagaaaaagaaagtgaaggtgccacttccagtagctccagctgataacaatcaaaatgcctcacaacctgttaggaaatgcatgcattgtgagataaccaagacaccacagtggagggcagggccaatggggccaaaaacactatgcaatgcatgtggtgttcgttacaagtccggccggctcttccccgaataccggcctgctgcaagtccaactttttgcccatccgtgcactccaattctcataagaaggtcctggaaatgagatgcaggggatttgacaaatctggttttgcaatcaattcagctgcctcacctgaactcattccaaacactaacagcagccttaccctggagtacatgtga

SEQ ID NO: 4417 - DNA, 555 bp, Glycine Max
atggtttatgggatactattctttgtcctatttgcattcactttgagtttagcttttctactctcaaagtgtctatcaaaaagtcaaacaaaaaatgttccaaaagggtctctgggataccctatcatcagagagacacttagttttctcaaagcacagagacaagataagggttctgtttggttggaagaacggatatctaagtatggccctatcttcaaaacctccttaatggggttccctacagtctttgtaattggacaagaaggaaacaagtttgtccttggttcaccagatgatttgctttcttctaagaaaccccttaccctcaccctgcgaaagatacttggaaggagaatgcctttttgtcttggatatacttgtgatttgctattgtttcttctctgttcaccatcacaggtcctccaactacttcatagcatctcattggatctctcaattggacaaccaacacgagtgtcaatttttctgcatgtcctgcagttttgcctatcatttcatctatgggcattaagggcaaaaccttggagttga

SEQ ID NO: 4418 - DNA, 768 bp, Glycine Max
atggttttctgggaaggatatgtgagcgatgaattgatgggcacgtttgcacctatcgtgctttattgggtatatgctggattttatcacttgctcccacctttagataggtatcggttgcatacgaggagagacgaggaaaagaagaatttggtacccttttcaacagtagtgaagggtgttttacttcagcagcttgttcaggcaattgtagcactcttcttgttgaccacaacagcaaatgcatctggtgttatagtgcagccttctatccccaagcaaattttgcaaatcgccattgcaatgttcgtgatggatacatggcagtactttgtgcatcggtacatgcatcagaacaagttcttatatcgccatatccactcccaacatcacagacttgttgttccttacgcaataggagccctttacaatcaccccatcgagggtcttctacttgacactgtaggtggtgccatctcatatcttgtctcagggatgactgcaagaacagcagttgtattcttctgctttgccatcgtgaaaacagttgatgatcactgtggattgtggttgcctggcaacatcttccatatctttttccagaataacacagcttaccatgacattcatcatcaactgcaagggctgaagtacaattattctcagccattcttttccatatgggacaaacttctcgggacatacatgcctttcaatcttgtaaagcggcctgaaggggggttcgaggcaaggctagcaaaggaatag

SEQ ID NO: 4419 - DNA, 930 bp, Glycine Max
atgtactgtttaaaggggcttgtgaattttactgatgctgttacatggttttgcgaggattgtgcaacaaagcttggggtgccacctgctcttgaccaatctacacctatcgcatctgtaacaagagaaaattgcatacagggagtgaaaaaacacaataaacagcgaaaaaagaagattacaaagaagcagattgaaggaaaagctaacgctggcttagttgctaaaacaaagggtgtgttatctgctagtcacagttcatctgagcctgagcatcctcattgtagtaacagaggcgaagaagaacatgaggtgaaaaatgactgtggaccagttccaagggatgtagctaattttgatgtaggtgaagaagaaagtgtggcaagggatttagctaattctgatgtaagtttcaaatctgttccagtttctcaaggagctaccaatagtgattcaggttgtgtagaagtagatggtcatgtttatgcacagcctactattgatccaatctggaggggaagtatgtacttttgcaatggaacaattcgtactgtcagtggacttctggctcatatctccaatttagcgtgctcccaagttgcggaggagacaggacatttcccagaagtgcttcatgcagaatttcttcccagagataaggtgtgggctgaaagtttcaagaggggggatccaactgatcaggacattgctctttttttctttcctgacagtgaaggatctgaaaaggacttcgatgtgctggttgaagatatcatgatctgtaaacatgtcataagatttgtgggtaaaaatgcagagcttttaatttttccttctactgagcttccagtccaaaattggagatatgaagccaagtattatttgtggggtgtcttcagaaagaaagcaaacttaagaagagacaaatga

SEQ ID NO: 4420 - DNA, 1011 bp, Glycine Max
atgtactttggaaaaaggttttatggttttgcttcagaggcacaaatggaaccaactgttgagtctgaactttttaaagcttttgagaaaacaaggctattggttggcaataagaaggaatcacagtattcaagatgtggtagaacagacaagggggtttcctctgttggacaagtgatagctcttttcctaagatcaaacctcaagatatctgaaacaaataatggaaattctggagttgttttggatgagcaacatgaaggggaaatagattatgttagagtgctaaatcgtgtccttccaaatgacattagaattatgggctggtgtcctgctcctgtggatttccatgcaaggttcagctgtttaagcagggagtataaatatttcttttggaaagaaaacttgaacatccaagccatggagagtgctggaaacaaacttgtaggagaacatgactttagaaacttctgtaaaatggatgcagcaaatgtgcacaactacaggcggcgcatcaagttgtttgagatttctcctacagatgtgagtcaacactttttcccatttacctgcaggtacaatgataatcaactttgggtgatcaagataagaggtagtgcctttctatggcatcaggttcgctgcatggttgttgttctattcatggttggcaaaggtcttgaatctccaaatgtgattgatatgctactggacactgctaggatcctaaggaaaccccagtacactatggcttcagaggttccattggttcttcagtcctgtgaatttgacaacattaagtttatgtgttcatcagaggcgggagaagcgttgcatgtacacttggtgaatgaatgccaaatttaccagcttcaagctgcaatctttcatgaagctcttcttaattgtgtgcctctatcaaatggtgttgcaaatgcatcaaagcttgctgcattttcaaggatccaagaagaaagtttcccatgtccctcttatgtcacgaccaactga

SEQ ID NO: 4421 - DNA, 852 bp, Glycine Max
atgtataggttcagcaacacagtaatcgggttcttgaacttgttcacacttttagcatccataccaataattggagcaggtctatggatggcaaggagcagcacaacctgtgagaattttctccaaacccctcttttggttataggattcgttgtgctagtggtgtcactagcaggcttcattggtgcatgttttcatgtggcatgtgcactatggttgtacttggtggtcatgttgttcctcatagcagcactcatgggcttcacaatatttggttttggtgtgactagcaagggcggtggtgtggaagtgcctggaagggtttacaaggagtatcgtcttcaagattactcaccatggttgaggaagagaattcaggatcctcgctattggaacactattagaggctgtattttggggtctaaaacttgtgaaaagcttgcctcttggacccctcttgattatatgcaaagggatatgtctccaatacagtctggatgttgtaagccaccaactgcttgcacttacaacgtggcaacaacaatgatgactcaagaccctgattgctacaggtggaacaatgcccctaatttgctatgctatgagtgtgattcttgcaaagctggtgtgcttgaagacataagagggaattggcacaagctctcggttctcacagtcaccatgcttgtgcttctcatagggatttattccattgggtgctgtgctttcagaaacacaagaagagctgaaacggattatccctatggtgaaaaccgcatgaccaaagtccgacctagatgggattaccattggtggaggtggttacatgacaggagagaacagctttattag

SEQ ID NO: 4422 - DNA, 840 bp, Glycine Max
atgtatcgaatgcagtgcatgaaggttagcactttggtctctggcgagattaattgtgttgatttaaaggctttacttcttgctcacaaggacaagccagccataatcaatctaaacatagggacaactatgaaaggaggagttgatgaccttgatcttgtaatacaaacacttcaagagtgtggtttcacacgtgatcgattctacattcattgtgatggagctctatttggaatgatgttgccttttgttgaacaagcacctaggattaccttcgagaaacccattggaagtgtggctatttctggccataagttcttaggatgtccaattccttgtggtattgtaataactcgtttacgatacatcaatgcattatcaagagatgttgaatatattggttcaagagatgttacaatcacaggtagccgttgcgggcatgctccaattttcctttggtacgccatcaaaagaaaaggtcttataggacttcaaaacgaagtgcgtaaatgcataatgaatgcacactatttacaaagtcgactacgtaatgcaggcattggtgcaatgttaaacaggtttagtagcactgttgtctttaagaggcctctagatgaagagtttactcgtaggtggaatttggcatgcaaaggaaatattgcacatgtggtagtgatgcaacatgttaccattgaaatgttggactcatttgttgctgaatttcttcaaaaacgatccatttggttcgaagacgaacaatttcaacatgtatgcattgcaaaagacattggttcgggaaattgtggttgttcaatgcacacaattcaatgtcacgattga

SEQ ID NO: 4423 - DNA, 927 bp, Glycine Max
atgtcaaaaggcacaatattatgtgatgcagaattgtcttctacgttttacgacagtgcttgccccattgcactcagcaccataagaactgtgattcgcagtgcagtatctgcggagcgccgcatggctgcgtctctcattcgccttcattttcatgattgctttgttcagggttgtgacgcatcaattttgcttgatgatagctcctctattgagagcgaaaagagtgcacttcagaatgcaaactcaataaggggatataacatcatcgatcaagcaaaatctgaggtggagaaactatgccccggagttgtgtcatgtgctgacattgtagcagtagcagcacgtgatgcatcatttgctgtgggaggtccatcatggactgtgaagcttggacgaagagattcaaccactgcaagcaaaagttcggctactagtgaccttccacgattcacagacgatcttgacactcttatctccagattcaataataagggtctcactgccagagacatggttactctatccggtgcccacacaatcggacaagctcaatgcttcacatttcgtggaagaatatacaacaatgcaagtgatattgatgcaggatttgctagcactcgccaacgtggttgtccatccgttagtaatgatgataatgacaagaaattggcatcactagacttggtcacacccaattctttcgacaacaactacttcaagaatttgattcagaagaagggtcttcttcaatcagatcaagttctgtttagtggaggatctacagattctattgtgtccgaatacagcaataagcctacaacctttaagtccgacttcgcagctgctatgattaaaatgggagatattcaaccattaactgcttcagctggaatcataagaaagatttgcagctctatcaactaa

SEQ ID NO: 4424 - DNA, 675 bp, Glycine Max
atgtcaccttctggtctgacttcagggggcaatgagatgcataattatattgctcgaaatgatgaccatactggtcaccgaattctaaaggacactaaaacacttggatctgcttatgaccgctaccttcaaagcgctgggcttacttcgtttaattctggggaagccagtgcaattagcagtgttggattgggaaggggtgttggtggattgccacatcattcactaactgatcctgctgtcacggggcatcctggtggtggtcatgatctttcacgaaatggacgtaatgtcaattatgccagtcagttaccagtagatgcagcttccatgcctggacctgagactctacctctacccccagatgcttcaagtactttatacgttgaaggtctcccatctggcagcacgagacgggaagtagctcatatttttcgccctttcgttggatatagagaagtaagacttgtgagcaaagaatccaaacatcgtggcggagatcctctaatcctttgttttgtggattttgcaaatccggcctgtgccgctactgctctgagtgcattgcaaggttataaagttgatgaactgaatcccgagtctagtcacttgcggcttcagttttctcggtttcctggtcccagatctggacctggacttcgtggcaagaggtga

SEQ ID NO: 4425 - DNA, 1041 bp, Glycine Max
atgtcattaacccaaattcctgagagatcatcatcaattgacatggaatcatgtgtgcctccaggatttagatttcatcccacagaagacgagcttgtggggtattacctcaagaggaagataaactcgctaaaaatcgatctagatgttattgttgagattgatctctacaaaatggaaccatgggacatacaagataggtgcaagctaggatatgagcagcagaatgagtggtactttttcagccataaagacaagaagtatccaacagggacaagaactaacagggcaactgctgctggattctggaaagcaacgggaagagacaaggctgttatgtccaaaaatagaatcataggaatgaggaagaccttggtgttctacaaaggacgtgctcctaatggaaggaaaacagactggattatgcatgaatataggcatcaaacttctgaacatggccctccacaggaagaaggatgggttgtgtgccgagcatttcgaaagcctagtccaagtcacaggccaggctttgaccacccatggtgcagtactagtagtcaacaacaacactttttcagagaccaaattcaaagctattcatcaagacccttatcaattgctgacattttggatgaaacaaataatgtgcctcaccctaatgctgaaggtacaagttttagtcaccccttcagctcggatcatcagcaacacctgaataatcttctatcaaaccaaactgtggctattatggacaaacaactcattgagcttccacagctagatagtcccactgcaagtttggcaatcaaagaatgtaaccaacaacaacataatggcttaacaaatgaggaatattgcagtgatgaaaggagtaacaatagcaatgcacaagggatcgattggaagagcttggacaacttgtttgggtctcaattgagtgataatgcagcttatttttcacatccaaacttgcccttgatgatgccccataaccatgatcaagctagtcatatccttggatgcttccctgattcttcataa

SEQ ID NO: 4426 - DNA, 651 bp, Glycine Max
atgtccaactttaaggttcaaacaacgccaattgttgttgaaaaagttaattgcataaaaaaaattcaaaaactaacaaaaataaaatctaaaggattgagtatctgtatcaccaatccaacaaaaaaaatgtctgtggcatcttcattcccatgcatcaaaatcccagcttgttcctcctctccatcatgcacatcttcatcaacttcatcatttagattttcttcttccaagccttatgctgctgtttctataaggaactctcagactgaagggcctctgagaagaccagtggctcctcctgtgagagaaccatcaagtagtgtccctcagccactgaagccttcacctccttctcaggttccgccccagaaggcttctcctgttgctggggatgataataatgtcattacattagagtttcagaggcagaaggctaaggagcttcaggagtatttcaaacagaagaagcttgaagatgcaaatcagggtcctttctttggattcattggcaaaaatgagattagcaatggaagatgggcaatgtttggttttgctgttggattgctaacagagtatgcaacgggatcagattttgttgatcaagtaaagatccttctctcgaattttggaatagtagatttggaatga

SEQ ID NO: 4427 - DNA, 1011 bp, Glycine Max
atgtccaccaccatttcttcccttcccttctctctcccacttcgccaaaattccagggttacccttttcaatccaccctcctcttctattccatcccaatcagcagtcacgtttcctaaaaagcaatggagatttttgtgtttaaggcatggaaacacttcatcggaaactgatggttctgagctcaaagaagataaattgtctgaagatttggtgaagctcgaaggtgaccagtccaaaaacctgaagaaagattggcttgcaactatccttacggtcgtaactgtcattcgtggtgtggaaccctggtcagttccttggacagcaaagatcattgttcaggtaatgcttctctggattgcctcattttggtttgtaggaacttggatagttccatttttagcatacacagcagggtttagaaaggaatctcttacatacagagggcaagcattgtacagcctcttgaccgatgttgccgaaggtgtgattgggatagcaattcttcaccattgtcttgcaaagtttcaacctctttcatctgattggttcaaatttgaactcaaggggaagtggccgtttgatgttggtttaggctgcctcatgttcccccttatcaatcagctatcacaaatgaacctaaatttgttgcctgttcttcaatatactccagttgccatctcaagtgtagagcagtccattgttgcacgagaccttgtggcaatggccctctatgcagtgatagtctcagtctgtgccccgatatgggaggagattgtcttccgtggtttccttctcccatctttaaccaagtacatgcctgtatggagtgcaatattagttagctcaatagcttttgcattggcacattttaacatccagagggtgctaccacttgtatttcttggcatggtgatgggcactgtctttgtacgttctaggaacctcttgccatcaatgttgttgcatagtttgtggaatgcttttgtatttctggatctcatgaaataa

SEQ ID NO: 4428 - DNA, 1491 bp, Glycine Max
atgtccatggatatgaagatgaacatgcttttctttctcgtcctttttgcttctgcaatttcctcttctcttgccaagggttccttgcaacaaacccttcttccttcagaagaattcaatgacggtagtaatgcaagcagtgcaaggcatttattagaggatgagtctcaggctcagacaagtgttgatttggcacaaggatttatgtccaatgatgaacttgaatgggccatccaagaatttggacaaagatgcagcaacatttccagggtatacagtattggaaagagtgtaaatggttttccattgtgggtgatagagatttctgacaagcctggagaagaagagactgaacctgcatttaagtatattggaaatgtgcacggtgatgaacctgtgggacgtgagctgcttatatttttggccaattggttatgtgataaccatttgaaggatcctttggcaacattgattgtggagaatgttcaccttcatttacttccatcaatgaatcctgatggttttagtttaagaaagcgtggtaatgctaataatattgatctgaatcgggattttcctgaccagtttgtttttataaatgatgatgaggattcccggcaacctgaaacaagagcgataatgaattggttgagagatatacgattcacagcatctgccactttgcatgggggggcacttgttgcaaattatccatgggatggcagcgatgacaaaaggacaaagtactatggttgtcctgatgatgatgcatttcgattcatgtcaagtatctacagtcactctcattacaatatgtcttcaagcaaggaatttctcggtggaatcacaaatggagcagcatggtaccctctatatgggggaatgcaagattggaactatatacatgctggctgttttgagttgaccctggaaattagtgataataaatggcctaatgctgctgagcttccttttctttggagatacaacaaaatgagcatgcttaatcttgtggcaagcctggtgaagacaggagtgcatggaagaatatattcttcaggcgatggaaggccattaccaggctctataactgtcagtggaataaattacacagttagagctggaaatacttttggtgactatcatcgcatactcgccccaagagataaatatgaagtagtggcaaccatgcctggctacaaatcaaagaatacaactatttggttggacgaaggaccagtgacattggattttgttcttgaccctgaagtcagtgtcaaagggagtgtactacgaaatatctatgattgtgactgtaatggtgaaagcaaacaagaatttgttcagtttctttggggaactcacttggaagttttctttgttgtgattgttgttttaggatttttacttttattatttcagagaagacaaaaagtcaaattttcaacaagcagacagtcagcgggggcaaaaagaactgttgaggtctaa

SEQ ID NO: 4429 - DNA, 819 bp, Glycine Max
atgtccatgttgtcgatgaagggcaaaaggtttgtatcagtgcctgtgttggcagtgattttgttaatggtttttgtgtattactgttcaatgttcgtcttcctccaagattggctcggtttgcagagttcccctggcactttgaatgcgttcctcttctctctctttgcctctctctccctcttctctttcttctcctgcgttctcactgaccctggccacgtcccttcttcctacgccccagatgttgaattctccaaagataatgcagaacagaagaaatgtgacaagtgctttgcatacaagcctcccaggactcatcattgtcgagtttgcagaaggtgtattctgaaaatggatcatcactgcttgtggataaataactgtgttggctattggaattataagacattctttgtttttgtattctatgccaccatggcaagtatttattctacgatcatatttatgagctgtgtatttcagaagtactgggatcccattaaaggaagttctcttaagaccttttttgtcttgtatggaacaatggtggtgggtttgaccataacccttttgactctttttggatggcatgtctaccttatccttcataacatgacaaccatagagtattatgaaggaaagcgtgcaaaatggttggctatgaagtctgggcaaagctatcggcatccattcaacattggcgcatacaaaaatattactttggtctctccctattttgtggtctttgctggcactaatttgcagatatgtactgatagtgtttcttacctaaggatatgttcgtctgtctcttga

SEQ ID NO: 4430 - DNA, 822 bp, Glycine Max
atgtccatgttgtcgatgaagggcaaaaggtttgtatcagtgcctgtgttggcagtgattttgttaatggtttttgtgtattactgttcaatgttcgtcttcctccaagattggctcggtttgcagagttcccctggcactttgaatgcgttcctcttctctctctttgcctctctctccctcttctctttcttctcctgcgttctcactgaccctggccacgtcccttcttcctacgccccagatgttgaattctccaaagataatgcagaacagaagaaatgtgacaagtgctttgcatacaagcctcccaggactcatcattgtcgagtttgcagaaggtgtattctgaaaatggatcatcactgcttgtggataaataactgtgttggctattggaattataagacattctttgtttttgtattctatgccaccatggcaagtatttattctacgatcatatttatgagctgtgtatttcagaagtactgggatcccattaaaggaagttctcttaagaccttttttgtcttgtatggaacaatggtggtgggtttgaccataacccttttgactctttttggatggcatgtctaccttatccttcataacatgacaaccatagagtattatgaaggaaagcgtgcaaaatggttggctatgaagtctgggcaaagctatcggcatccattcaacattggcgcatacaaaaatattactttggttttaggtccaaacatgctgaaatggttatgtcccacggcagtaagccatctcaaggacggggttagcttccccacattacgtgataattcttaa

SEQ ID NO: 4431 - DNA, 1236 bp, Glycine Max
atgtcctacatcgccgtcgactacctccgccacctttctccggtgtggcactcgcgtctgcaaccggcactgtggtccctcctcgccctcgctgccgtggtccgcgtcccctcctaccggcactggtccgcggagttccggtcggcgattccgttcatcgcctccatgttctttatgctcgccgccctcctctacgaaatgatctccgtccgctccgtcaccgctgtgctcggcctcgactggcacctgaatacacctcctcttccagatacggggcaatggttgctcttggcgttaaatgagaaacttccttctccaattgttgagatattaagagctcgaatcattggactgcaccattacttgatgctgtttatgatgctggctttctctgtgctatttgattctgtgaaagctccaggcctcggattaggtgctaggtacatgtttaccatggcagttggtcgccttcttcgtgccataacttttgcatctacaattctgccatcagctcgcccttggtgtgctggttctcggttcagagttccgggatatcctcatcgttgggctcagaaatattatgttccctatgctacagatcatgatgctatcagccgggtgataaaggtcgatacagcttatgttgacattggaaaaccagttggtgactaccagccaaattggggttcgatgagctttctaattgattttatgcgacccactgtctccgaaggaccttcatggtacagtctgttaaagaaagctggaggtggctgcaatgacctcctatacagtggccacatgcttgtagccgtactcacagccatggcttggacggaagcatatggaggattcagttctgctcttgtatggcttcttgtgatgcacagtgcccaaagagaaatacgagaacgccatcattacactgtagactgcattgtggccatctatgtggggattctcttatggaagatgacaggttttatctggtcacgtgaagctacatctagtaataggaggctgaataagtttgagaagattcaaagcagactaatccaagcttcaaaagactcggacattgatgaagtgagggagcttctcaaagagtttgagttaagcagtgaagagagcaagaatcagattggaattaaatatgcacggttgtttcgaagtgccaccattgtctttgccctcaccattgttgttctggctttcacattgacaagtgatggatga

SEQ ID NO: 4432 - DNA, 1293 bp, Glycine Max
atgtccttccgcagtatagttcgtgaagtaagggatggatttggaagcctatcaaggaggagttttgaggtaaggcttcctggccataacaggggcaagtcacgtagtttggtccacgagttgcaggatcagccaccagttatacagaacagccggtgggctagccttcctcctgagcttcttcgcgatgttattaatagattggaagcaagcgagagtacatggcctggtcgtaagcatgtggttgcgtgtgctgccgtgtgcaagtcctggagagaaatgtgcaaagaaattgtcagcagtcctgaattctgtgggaagattactttccctgtttccttgaaacagcctgggcatagggatggacccatccagtgtttcatcaagagagacaaatctaagctgacataccacctcttccttggccttagccctgccttgcttgttgaaaatggaaagtttcttctctctgcaaaacggacaagaagaacaacttgcacagagtatgttatatcaatggatgcagataacatatcgagatctagtagtacttatattggaaaactgaggtctaattttcttggcaccaagtttataatttatgatacgcaacctccctacaacaatgctatgctgtctccacctggccgcagccgtaggttttcaaaaaaggtttctccaaaggtccctagcggcagctacaatattgcccaggtcacctatgagttgaatgtccttggtactagggggccacgaaggatgaattgcacaatgtactcaattcctgcatcatccatggagcctaatggcgttgtcccaggccagccagagctccttccccgtgcccttgaggattctttccggagtatatccttctcaaaatcaatcgacaattcaaccgagtttagcagctctaggttctctgacataatgggaactggcattgaagacgaggagggaaaggtgagaccactagttctcaagaacaagtctccaaggtggcatgaacagctgcaatgttggtgcctcaactttagaggaagggtcactgttgcctctgtcaagaattttcagctgattgcctcaacaccgccagcagccgttgctcctacaggaacaggacctacaccatctcagccaacacagtcttcttctgaccctgacaagattattcttcagtttggcaaggttggcaaggatatgtttacaatggactatcgataccccctttctgcatttcaggcttttgccatatgcttgactagttttgacacaaaactggcttgtgaatag

SEQ ID NO: 4433 - DNA, 1293 bp, Glycine Max; identical to SEQ ID NO: 4432

SEQ ID NO: 4434 - DNA, 657 bp, Glycine Max
atgtcgagcgccgatcccgagcacagagaagaggaggaggcacccgccgttggcgacgacgaggacaccggagctcacgtcgctccaatcgtcaagctcgaggaggttgctgtcaccaccggcgaggaggacgaagatgcaatcctggatctcaaatcgaagctttaccggttcgacaaggacgggaaccagtggaaggagcgtggcgccggcactgtgaagttcctgaagcataaggcttccggcaaggttaggcttctcatgaggcaatccaagacgctcaagatctgcgctaatcatctcattttgcctacgatgagtgtgcaagagcacgctgggaacgagaaatcctgcgtttggcatgctagggattttgctgatggtgaactcaaggacgagctcttctgcatccgttttccttctattgaaaattgcaaaagcttcatggaaacattccaagaagttgctgaaacacaaaaggcagaggatgagaaggaatcatctgatgcagctggtcttattgagaaattaagtgttgaagagaaggctgatgcagagaagaaagatgaagagaagtctgaggacaaaactgtggagaaagaatctgcatcaggaaaggaaagcaaggcagttgaagagcctgcgtcctcagcttga

SEQ ID NO: 4435 - DNA, 972 bp, Glycine Max
atgtcgcgacagagatccagaagagtcgaactacctcccgctcaggagaatattgaaaaattggagaaggttgtaaacgatggaaattattatggagctcagcaaatgtacaaatccgttagtgccagatatgtttctgctcagaggtactgtgaagcattagatatcctacattcaggagcgtgcattcaattgtctcatgggcaggttacctgtggagcagagctagctctattgtttgtggagacattagggaaagggaaaattccttacaatgaggaaattcttgaacgtctcgacaaaatttacaaatcatttcctcgggtttcattgccacaaaacctatgggatgtcgatgacatgcagcagctttctgaaaacattggaagtgcaaagacacgtgttgagggctgctcctcattcttaaaagctgctatcaagtggtctgccggaaatggagtaaataagaatggatctccagagctgcacatcatgctagctgagtacatattttctgaaagtcctgaggtggatatggctaaagtgacacatcattttgtgagaggaaataatccaaagaagtttgcttctactctagtgagttttttgggcaagtgttatcctggtgaagatgatttggccattgctcgggcagttttaaggtacttgtcttcaggtaatttgaaagatgcgaacatactaatggaagagataaagaagcaaactgaatcggctgaggttgcatttcctaagacagagttgatgcaatttatcgcatatcttttgcaaacgttggagagagatgctttgcctctttttagtatgttgagagcaaattttaagccaagtattgagagggagcctgcgttcaatgagatgctagatgatattgcggagaggttctttggagtacagcgaaggaaccccatgggaatgtttggagatatattcaaggtgactactgatagctga

SEQ ID NO: 4436 - DNA, 972 bp, Glycine Max
atgtcgcgacagagatccagaagagtcgaactacctcccgctcaggagaatattgaaaaattggagaaggttgtaaacgatggaaattattatggagctcagcaaatgtacaaatccgttagtgccagatatgtttctgctcagaggtactgtgaagcattagatatcctacattcaggagcgtgcattcaattgtctcatgggcaggttacctgtggagcagagctagctctattgtttgtggagacattagggaaagggaaaattccttacaatgaggaaattcttgaacgtctcgacaaaatttacaaatcatttcctcgggtttcattgccacaaaacctatgggatgtcgatgacatgcagcagctttctgaaaacattggaagtgcaaagacacgtgttgagggctgctcctcattcttaaaagctgctatcaagtggtctgccggaaatggagtaaataagaatggatctccagagctgcacatcatgctagctgagtacatattttctgaaagtcctgaggtggatatggctaaagtgacacatcattttgtgagaggaaataatccaaagaagtttgcttctactctagtgagttttttgggcaagtgttatcctggtgaagatgatttggccattgctcgggcagttttaaggtacttgtcttcaggtaatttgaaagatgcgaacatactaatggaagagataaagaagcaaactgaatcggctgaggttgcatttcctaagacagagttgatgcaatttatcgcatatcttttgcaaacgttggagagagatgctttgcctctttttagtatgttgagagcaaattttaagccaagtattgagagggagcctgcgttcaatgagatgctagatgatattgcggagaggttctttggagtacagcgaaggaaccccatgggaatgtttggagatatattcaagttgatgggagctgagtaa

SEQ ID NO: 4437 - DNA, 909 bp, Glycine Max
atgtcgcgacagagatccagaagagtcgaactacctcccgctcaggagaatattgaaaaattggagaaggttgtaaacgatggaaattattatggagctcagcaaatgtacaaatccgttagtgccagatatgtttctgctcagaggtactgtgaagcattagatatcctacattcaggagcgtgcattcaattgtctcatgggcaggttacctgtggagcagagctagctctattgtttgtggagacattagggaaagggaaaattccttacaatgaggaaattcttgaacgtctcgacaaaatttacaaatcatttcctcgggtttcattgccacaaaacctatgggatgtcgatgacatgcagcagctttctgaaaacattggaagtgcaaagacacgtgttgagggctgctcctcattcttaaaagctgctatcaagtggtctgccggaaatggagtaaataagaatggatctccagagctgcacatcatgctagctgagtacatattttctgaaagtcctgaggtggatatggctaaagtgacacatcattttgtgagaggaaataatccaaagaagtttgcttctactctagtgagttttttgggcaagtgttatcctggtgaagatgatttggccattgctcgggcagttttaaggtacttgtcttcaggtaatttgaaagatgcgaacatactaatggaagagataaagaagcaaactgaatcggctgaggttgcatttcctaagacagagttgatgcaatttatcgcatatcttttgcaaacgttggagagagatgctttgcctctttttagtatgttgagagcaaattttaagccaagtattgagagggagcctgcgttcaatgagccatctgctgcatttgatgtgacaaaactgtga

SEQ ID NO: 4438 - DNA, 885 bp, Glycine Max
atgtcgcgacagagatccagaagagtcgaactacctcccgctcaggagaatattgaaaaattggagaaggttgtaaacgatggaaattattatggagctcagcaaatgtacaaatccgttagtgccagatatgtttctgctcagaggtactgtgaagcattagatatcctacattcaggagcgtgcattcaattgtctcatgggcaggttacctgtggagcagagctagctctattgtttgtggagacattagggaaagggaaaattccttacaatgaggaaattcttgaacgtctcgacaaaatttacaaatcatttcctcgggtttcattgccacaaaacctatgggatgtcgatgacatgcagcagctttctgaaaacattggaagtgcaaagacacgtgttgagggctgctcctcattcttaaaagctgctatcaagtggtctgccggaaatggagtaaataagaatggatctccagagctgcacatcatgctagctgagtacatattttctgaaagtcctgaggtggatatggctaaagtgacacatcattttgtgagaggaaataatccaaagaagtttgcttctactctagtgagttttttgggcaagtgttatcctggtgaagatgatttggccattgctcgggcagttttaaggtacttgtcttcaggtaatttgaaagatgcgaacatactaatggaagagataaagaagcaaactgaatcggctgaggttgcatttcctaagacagagttgatgcaatttatcgcatatcttttgcaaacgttggagagagatgctttgcctctttttagtatgttgagagcaaattttaagccaagtattgagagggagcctgcgttcaatgaggtcagataa

SEQ ID NO: 4439 - DNA, 3534 bp, Glycine Max
atgtcgtcatcttcgtcttcgatggctgcttccagtgaaaggtggattgaccgtcttcagtactcctcattgttctggcctcccccaccagatggtcaacaaagaaaggatcaaattgctgcatatgttgagtacttcattcagtttacatcagaacaatttgctgatgatattgctgagttgatccgtaaccattatccatccaaggatattcttctctttgatgatgttttggcgacatttgtccttcatcatccagagcatgggcatgcagttgtgcttccaattatttcatgtattattgatggtacactagtctatgataaggctagtcctccatttgcttctttcatatcttcagtctgcccaaaaattgagaatgaatactcggaggaatgggctctagcatgtggtgaaattttgcgcattttaactcattacaatcgccctatttacaaaacagaaagacaatctggtgaaaccgaaagaagcactagtggcagtcatgccacaactagtgaacctgggaaatctgggcataattctttgacacagcatgagaagaaacctataaggccgttgtccccctggattactgatattttgttggcttcaccagtaggtattcgaagtgactatttccgatggtgcagtggtattatggggaaatatgctgcaggagaactcaagcctccatcaaccgcttcttcccgtggttctgggaagcatcctcaacttgtgccttcaactccaagatgggctgttgccaatggtgctggtgttatattaagtgtttgtgatgatgaagttgctcgcaatgagactgctactttaacagcagctgctgtccctgcgcttttgcttcctcctccaacgacagctctggatgagcatcttgttgctggattaccagctctggaaccatatgctcgtttatttcatagatattatgcaattgctactccaagtgctacacaaagacttcttcttggacttctagaagcacccccatcatgggctccagatgcacttgacgctgctgtgcagcttgtggagcttcttcgagctgctgaagattatgcatctggcataaggcttcctagaaattggatgcatttgcatttcttgcgtgcaatagggactgcaatgtccatgagagctggtatagccgctgatgctgcagctgctcttctttttcgtatactttcccagcctgcattgctttttcctcctcttagacaagttgacggagttgaagttcaacatgaacctttgggtggttatatttcttcctataaaaagcagatagaagttcctgcagctgaagcctctattgaagctactgcccaaggcattgcatcaatgctttgtgcccatggtccagaggttgaatggagaatttgcaccatttgggaagctgcttatggcctgattcctacaagttcctcagctgttgatcttccggaaattatagttgcaaccccactacagcctcccgtgctgtcatggaatttgtacatacccctattgaaggtcctggaatatcttcctcgtggaagcccatcagaggcatgtcttatgaaaatatttgctgctacagtggaagctattcttcagaggacatttccacctgagtccactagagaacaaaacagaaaatcaaaatacctagctggcataggctttggctctgcctcaaaaaacctggccgtggcagaacttcgtacaatggttcattcactcttcttagaatcatgtgcatctgtagagcttgcttcacgcctactttttgttgtcttaactgtctgcgtcagtcatgaagctcaattcagtggaagcaagaggccaagaggtgaagataactattcatctgaggatatcattgaggacttacaaacatctgaaaaccagaaagaatcaaaaaataggaaattgaagaagcaaggtcctgttgcagcatttgattcttatgttctggctgccgtttgtgcccttgcctgtgagcttcagttgttccctttgatttcacgggggaataatcatttagcttccaataaggtgcaagatatagccaagcctgttagactaaatggatcctcccatgagttgcggaatggcttagattcagcagtacgtcatactcacagaattttagcaattttagaggcactattttcattgaagccatcttctgttggaaccccttggagttacagctcaaatgagatagttgcagctgctatggttgctgcccatgtttctgaactatttagaaggtcaaaagcttgcatgcatgctctgtctgttctgattcgttgcaaatgggacaatgaaattcactccagggcatcatcattgtataatctcatagatattcacagcaaagctgttgcatctatagtgaacaaggcagagccattagaagcaaccttaattcatgcacctattcggaaggattcccttgtttgtgttggtgttaaaaggcagaatcagtgtgaaagtagtagctgttttgatgctgggcggacatctgttgtaccttcagaagattcattcccatcaaaacttgaccataattctaacaaaaccccatgtccaaagggtgcatcagattataccttgggtaaaggtgtcacaggtttctcattggatgcgtctgatctagccaacttcctcacaatggacaggcatataggattgaattgcaatggacaaatttttctaagatccacgctagcagagaaacaagaattatgtttttctgtagtttcactgctatggcacaagctgattgcatctcctgaaacacaaccttgtgcagaaagcacttctgcccaacagggctggagacaggttgttgatgcattatgcaacgttgtatcagcctcaccaacaaaagcagctacagcagttgtacttcaggcggagcgggaattgcagccctggattgccaaggatgatgattcaggtcagaagatgtggagaatcaatcagcggattgtaaaattgattgtggaacttatgaggaatcatgagactgcagaatcattggtaattgtggcaagttcatcagatttactactgcgagccacagatgggatgctggttgatggagaagcttgcactttaccacagctggagctattggaagcaacagctagagcagttcagccagtgctcgagtttggagaatctggattggctgtggcagatggcctttcaaaccttttaaagtgtcgcctctcagctacaattagatgtctttctcatccaagtgcacatgtccgagctctgagtatatcagttcttcgtgacattttgcatactggttcaatcagatgtagtcctaaacctcggagattaaatggcacccacaacccttcttatcaatacttcaatttggatgccgttgactggcaagctgacatagaaaaatgcttgacttgggaagctcacagccgactttcaaacggattgtctattaactttcttgatatcgctgccaaagagttaggctgtactatttccatgtga

SEQ ID NO: 4440 - DNA, 3534 bp, Glycine Max; identical to SEQ ID NO: 4439

SEQ ID NO: 4441 - DNA, 621 bp, Glycine Max
atgtcgttgcgcaggcgaaccttgctcaaggtcattgttctcggcgatagcggggttggaaagacctcgttgatgaatcaatacgtgcacaagaagtttagtcagcaatataaggctaccattggggctgattttgtcaccaaagagcttcagattgatgacagacttgtcactctacaaatatgggacactgctgggcaagagagattccagagtctcggggttgcattttacagaggtgccgattgctgtgttcttgtgtatgatgtgaatgtgatgaaatcgtttgatacccttgagaactggcacgaggagtttctcaaacaggcaaaccctcctgatccaagggcatttccgtttattttactcggaaacaagatcgatattgacggtgggaatagtcgagtggtttctgagaagaaagcgaaggactggtgtgcctcaaaagggaatattccctactttgaaacatctgcaaaagaggattacaatgttgatgctgcattcctgtgtattgccaaggctgctctagccaatgagcacgaacaagacatatattttcaagggattcctgaggcagcagttccagagaatgagcagaggagtggatgtgcatgctga

SEQ ID NO: 4442 - DNA, 345 bp, Glycine Max
atgtctaccaatattatttttctctccaagtttctgctccttcttatccttcttttgaaccctgatcatgatgccaacaacacaagagggtgttctacattcgtttgtgtggctggtgcaagacccttattggaatataatgttccaaaatacattaacttgaagcctcatgatgagaaaggcaatggaataaagaaaggtttcgtccaaggagggggcgtggaagcttgtttgccaaaagggtttcgacgatcttctgctccaagcagatatattaattatcagcctcttggatcgacatgttcatcaagcaaggtagtgaataataatggtcctcgagcatga

SEQ ID NO: 4443 - DNA, 1170 bp, Glycine Max
atgtctcacaggaagttcgagcacccaaggcacggttcactgggatttcttcccaggaagcgtgctgctcgtcacaggggaaaagtgaaggcattccccaaggatgacccatccaaggcacccaagctcactgcattcttgggttacaaggccggtatgactcacattgttagagaggtcgagaagccaggatcaaagcttcacaagaaggaaacttgtgagcctgttacaattattgagacccctccaatggttattgttggtgttgtgggttatgtgaaaactccacgtggtctccgaacattgaacactgtctgggctcagcatttgagtgaggaattgaaacgtaggttctacaagaactggtgcaagtccaagaagaaggccttcaccaagtactctaagcagtatgaaactgaggagggaaagaaaaacattgaggcgcagctggagaaactgaagaagtatgctactgtggttcgtgttttggctcacactcagatcaggaaaatgaaagggttgaagcagaagaaagcccatatcatggaaattcaggttaatggtggtagtattgcacaaaaggtggactttgcatacagtttctttgagaaacaggttcctattgatgcagtgttccagaaggatgagatgattgacatcattggtgtgaccaagggtaaaggttatgagggtgttgtcactcgttggggtgttacccgccttccccgtaagactcacagaggtttgaggaaggttgcttgtattggtgcctggcatcctgcaagagtttcattcactgttgccagggctggtcagaatggataccaccaccgaactgagttgaacaagaaggtttacaagcttggcaaagctggagatgaatctcactctgctcttactgagtttgataggaccgagaaagacattaccccaatgggtggtttccctcactatggtgttgttaaggatgattttatcatggtcaagggatgctgtgttggtcccaagaagagggtcattacattgcgtcaatccctccttaagcagacttctcgtgttgctcttgaggagatcaaactcaagtttatcgatacctcttcaaagtttgggcatggtcgcttccagaccacacaggagaagcagaagttctttggacgcctcaaagcataa

SEQ ID NO: 4444 - DNA, 1737 bp, Glycine Max
atgtctcatgtagtggtcactcgatccattcacacctccctcacgcgccccacctcaggatctgcacaccacagagcccaaacgttgttgaagcctccaacttttgcttccaaagtgttcccacaacaaaggaacaacccctccaaagtttgctcccgaagttgcctcgtcaatgcgaggaaatctgcacccactgaagttgttcccgtctcacccgaggatgattcaaagattgaggaagagttgcagcactcgcgtggtatgcggcaacttggtgacacttctgttggaatgtggtcaaaacccacttttaggaggaagacaaaggttgtttgcaccattggtccttctaccaacaccagggaaatgatttggaagctggctgaggctgggatgaatgttgcccgattgaatatgtctcatggagaccatgcttctcatcagaaaattattgatttggttaaagaatataatgctcaatccaaggacaatgtaattgcaattatgcttgataccaagggtcctgaggttaggagtggggatttgccacaaccaatcaatttaacaactgggcaggaattcacatttaccatccggaggggtgttggaactgcagattgtgttagtgtgaactatgacgatttcgtcaatgatgtggatgtgggggacatgcttcttgttgatggtggtatgatgtctttggtggttaagtctaagacagaggattctgtgaaatgtgaagttgttgatggaggagagctcaagtcaaggagacatttgaatgttagaggaaaaagtgcaacacttccttccatcactgagaaggattgggatgacatcaaatttggagtggataacaaagttgacttctatgctgtttcttttgttaaagatgcacaagtagttcatgaactgaagaattatttgaaaagctgtgatgctgatatacatgtcattgtaaaaattgaaagtgcagactctataccaaacttgcattcaattattacagcgtctgatggggccatggttgcaagaggagatcttggtgcagagctccctattgaagaggttccacttttgcaggaagagataataagcatatgccgtagcatgggaaaggctgttattgtggcaacaaatatgctggaaagcatgattgttcacccaacaccaaccagagccgaggtatccgatattgcaattgctgttcgagaaggttctgatgcaataatgctttctggggaaactgctcacggaaagttcccgctaaaagccgtgaaagtaatgcataccgtagcattacggacagaagccaccatacccggtggtcagatgccaccaaatattggtcaagtattcaagaaccacatgagtgagatgtttgcttaccatgcaaccatgatgtctaataccctcggaacctcaactgttgtcttcactagatcaggcttcatggctatccttttgagccactatcgaccttcaggcaccatatttgcttttacagatcaaaagaggatacaacagaggttggctttgtatcaaggagtctgtcctatttacatggaattctctgaagatgctgaagagactttcacaagggccttggatttgctgcagaagcaaggaatggtgaaatcaggagaagaagtagcactagtacaaagtggcaggcaacccatatggaggttccaatccactcacaatatccaggtccgaacagtgaaaacaaaataa

SEQ ID NO: 4445 - DNA, 459 bp, Glycine Max
atgtctctggtggcgaacgaggatttccagcacattctgcgtgtgctgaacaccaacgtggatgggaagcagaagataatgttcgcaatgacctccatcaagggtattggaaggagattcgccaacatcgcttgcaagaaggctgatgttgacatgaacaaaagggctggtgagttgactgctgctgagttggacagtgtgatgactgtggtggcgaaccctaggcagttcaagatcccaaactggtttttgaacagaaagaaggattacaaggatggcaaatactctcaagttgtgtctaatgctcttgatatgaagctcagggatgatctcgagagactcaagaaaatcaggaaccatcgtggtttgagacactactggggtcttcgtgtacgtggccagcataccaagaccactggtcgtaggggtaaaactgttggtgtgtccaagaagcgctga

SEQ ID NO: 4446 - DNA, 357 bp, Glycine Max
atgtctctggtggcgaacgaggatttccagcacattctgcgtgtgctgaacaccaacgtggatgggaagcagaagataatgttcgcaatgacctccatcaagggtattggaaggagattcgccaacatcgcttgcaagaaggctgatgttgacatgaacaaaagggctggtgagttgactgctgctgagttggacagtgtgatgactgtggtggcgaaccctaggcagttcaagatcccaaactggtttttgaacagaaagaaggattacaaggatggcaaatactctcaagttgtgtctaatgctcttgatatgaagctcagggatgatctcgagagactcaagaaaatcaggtaa

SEQ ID NO: 4447 - DNA, 459 bp, Glycine Max
atgtctctggtggcgaacgaggatttccagcacattctgcgtgtgctgaacaccaacgtggatgggaagcagaagataatgttcgcaatgacctccatcaagggtattggaaggagattcgccaacatcgcttgcaagaaggctgatgttgacatgaacaaaagggctggtgagttgactgctgctgagttggatagtgtgatgactgtggtggcgaaccctaggcagttcaagatcccagactggtttttgaacagaaagaaggattacaaggatggcaaatactctcaagttgtgtctaatgctcttgatatgaagctcagggatgatcttgagagactcaagaaaatcagaaaccaccgtggtttgaggcattactggggccttcgtgtccgtggtcagcacaccaagactactggccgtaggggaaagactgttggtgtctctaagaagcgttaa

SEQ ID NO: 4448 - DNA, 546 bp, Glycine Max
atgtctctggtggcgaacgaggatttccagcacattctgcgtgtgctgaacaccaacgtggatgggaagcagaagataatgttcgcaatgacctccatcaagggtattggaaggagattcgccaacatcgcttgcaagaaggctgatgttgacatgaacaaaaggtgcttttttttattggttgagttcaattgctcgttaattcgcacatttttgtggttattgttgaaattgggatttttgtttgtcagggctggtgagttgactgctgctgagttggacagtgtgatgactgtggtggcgaaccctaggcagttcaagatcccaaactggtttttgaacagaaagaaggattacaaggatggcaaatactctcaagttgtgtctaatgctcttgatatgaagctcagggatgatctcgagagactcaagaaaatcaggaaccatcgtggtttgagacactactggggtcttcgtgtacgtggccagcataccaagaccactggtcgtaggggtaaaactgttggtgtgtccaagaagcgctga

SEQ ID NO: 4449 - DNA, 429 bp, Glycine Max
atgtctggcaattcgaattgcagtgtttacataggcaatctggatgagagggtgacggacagggtcttgtatgatatattaattcaagcaggaagagtggtagacttgcacattcctaaagataaggaatcagagaaaccaaaaggttttgcctttgcagaatatgaaactgaggagattgcagactatgctgtccggcttttctcaggcctcataacactgtacaacagaacacttaagtttgcgatatctgggagagacaaaactacctctaatggttctacagcaattacccccacatcaaattcttctcaaagaccaaggccatatccagtgtctataaacaattcagaaaattttcagcactctgctaggctatcaactcctgaccgattttcagatcatccagtaaattattcccaagagtaa

SEQ ID NO: 4450 - DNA, 447 bp, Glycine Max
atgtctggcaattcgaattgcagtgtttacataggcaatctggatgagagggtgacggacagggtcttgtatgatatattaattcaagcaggaagagtggtagacttgcacattcctaaagataaggaatcagagaaaccaaaaggttttgcctttgcagaatatgaaactgaggagattgcagactatgctgtccggcttttctcaggcctcataacactgtacaacagaacacttaagtttgcgatatctgggagagacaaaactacctctaatggttctacagcaattacccccacatcaaattcttctcaaagaccaaggccatatccagtgtctataaacaattcagaaaattttcagcactctgctaggctatcaactcctgaccgattttcagatcatccagtaaattattcccaaggtgtaaaacagtatattcaatga

SEQ ID NO: 4451 - DNA, 561 bp, Glycine Max
atgtctggcaattcgaattgcagtgtttacataggcaatctggatgagagggtgacggacagggtcttgtatgatatattaattcaagcaggaagagtggtagacttgcacattcctaaagataaggaatcagagaaaccaaaaggttttgcctttgcagaatatgaaactgaggagattgcagactatgctgtccggcttttctcaggcctcataacactgtacaacagaacacttaagtttgcgatatctgggagagacaaaactacctctaatggttctacagcaattacccccacatcaaattcttctcaaagaccaaggccatatccagtgtctataaacaattcagaaaattttcagcactctgctaggctatcaactcctgaccgattttcagatcatccagtaaattattcccaagttcttccttctcgtgtaactgaccaatctagtgggtatggatctcactatagtggcaacaattatgaatacagcaggagagcttttggggcaacattggatagcattagccgttctaggtcacgccgctttgattaa

SEQ ID NO: 4452 - DNA, 894 bp, Glycine Max
atgtctgttcaaaaggatcaagataagttcttcttgtccatcagtcaaggagagaaaaaaccatttgactttttacgtgttttatatgatggttgcattgctggaggtgctgctggtgttgttgtagaaacagctttataccccattgataccatcaaaactcgactacaggttgctcgcgacggagggaaaattgttttgaagggtctgtactctgggttggctggaaatattgttggtgtcttaccagcttcagcaatttttattggtgtgtatgaacccacaaagcagcaattgctaaagtcattgcctgaaaatctcagtgccgtggctcattttgctgcaggtgctattggaggcattgcttcttctgttgttcgtgttccaactgaggttgttaagcaaaggatgcagattgggcaatttaaatcagccccagatgctgtccgtcttattgttgctaatgagggttttaaaggtctttttgcgggatatggatctttcttattgcgagatttaccatttgatgctatagaattatgcatttatgagcagctccgtattgggtataaattagcggcaaaaagagatcctaatgatccagagaatgctatgcttggggcagtggctggtgcggtaactggagcagttacaactcctcttgatgtagtaaagaccagattgatggttcagggatcacaaaaccattacaaaggcatttctgattgtgtgagaacaatagttaaagaagaaggaagtcatgctctttttaaaggtattgggcctagagttttgtggataggaattggaggttcaatatttttttgtgttcttgagaagactaagaaaattcttgctcagaaacggcactccaaagctgagactcagaattga

SEQ ID NO: 4453 - DNA, 894 bp, Glycine Max; identical to SEQ ID NO: 4452

SEQ ID NO: 4454 - DNA, 837 bp, Glycine Max
atgtctgttcaaaaggatcaagataagttcttcttgtccatcagtcaaggagagaaaaaaccatttgactttttacgtgttttatatgatggttgcattgctggaggtgctgctggtgttgttgtagaaacagctttataccccattgataccatcaaaactcgactacaggttgctcgcgacggagggaaaattgttttgaagggtctgtactctgggttggctggaaatattgttggtgtcttaccagcttcagcaatttttattggtgtgtatgaacccacaaagcagcaattgctaaagtcattgcctgaaaatctcagtgccgtggctcattttgctgcaggtgctattggaggcattgcttcttctgttgttcgtgttccaactgaggttgttaagcaaaggatgcagattgggcaatttaaatcagccccagatgctgtccgtcttattgttgctaatgagggttttaaaggtctttttgcgggatatggatctttcttattgcgagatttaccatttgatgctatagaattatgcatttatgagcagctccgtattgggtataaattagcggcaaaaagagatcctaatgatccagagaatgctatgcttggggcagtggctggtgcggtaactggagcagttacaactcctcttgatgtagtaaagaccagattgatggttcagggatcacaaaaccattacaaaggcatttctgattgtgtgagaacaatagttaaagaagaaggaagtcatgctctttttaaagtatggatatttcttaagattcggtgtaacactaatcattatttgtattctttaacccaatag

SEQ ID NO: 4455 - DNA, 1449 bp, Glycine Max
atgtcttcaaagtgcaaaaatgtgatgccgcacgagactccgaacgtgaaggagcactacgtgattgggaacaaggtactaggaaaagggcacgtggcgacaacatacgtgtgcactcacaaggagacaaagaagaggtatgcatgcaaaacgatcccaaaggcgaagctgttgaagcaagaggactacgacgaagtgtggagggagattcaggtgatgcaccatttgtcggagcaccccaacgtggccagggtgcagggaagctacgaggacaaattcgccgtgcaccttgtcatggagatgtgccgtggcggcgagcttttctataggatcactcagaagggtcattacagcgagaaagaggctgccaagttgatgaagaccattgttggagtggtcgaggcttgtcactctcttggggtcatccatagggatctcaagcctgagaatttcttgtttgatagccattccgaaactgccaccatcaaggtcatcgatttcggattctctgtcttctacaagccaggacaaacgtttagtgatatagtaggaacttgctactacatggctcctgaggttttacgcaagcaaactggaccagaagtggacgtatggagtgctggtgttatcctatacatcttactgagagggcacccacctttctgggcaaaatccgaatcagcaattttccaagagattttacatggagagattgattttgtttctgatccgtggccaagtatatcagaaagtgctaaggatttgataaaaaaaatgttggataaggaccctgagaaaagaatctctgctcatgaagtcttatgtcacccttggattgttgatgatagtgttgcccctgacaaacctctggaccctgctgttttgacacgcctaaagcatttctcaacaatgaataaacttcagaagatggcattacgtatcatagcagaaagactttcagaggaagaaataggcggattaaaagagttatttaaaatgattgatgaagacaatagtgggacaatcacttttgaggaactcaaggatagtttgaaaagtgtgggctgtgatctcatggaatctgaaattaaatcccttatggaagcggctgatatagacaacaatggaacaatagactatggtgaatttctcgctgctacactgcacttgaataagatggaacgagaagagaatttggttgctgcttttgcctattttgataaagatggtagtggctacatcaccattgaagagattcaacaggcttgtaaagactttggccttggtaatatgcacctggatgagataatcaatgagattgatcaagacaacgatgggagaattaattattcagagtttgcagcaatgatgagaaagggtggtccagatgttggtaggagcagaaaaggcaattatacagcttcaatattggatgtgcttgtggagtga

SEQ ID NO: 4456 - DNA, 2289 bp, Glycine Max
atgtgtagcagtttgaagattcattgcaacgagaaggacatgaacaaactcctacgcttcaaaaaaggagtcagagatccttcaggcatgctctcctcatggctcccaaaattagattgttgtcgatggacaggagtcaagtgtgataatatcactggcagagttacacagcttagtctcccatgtcacacaactcaacctgaagttgttgcttatcaagagaaagacgacaaatcacactgcctaacaggtgaattcagccttaccttgctggaacttgaatttttgagctacttggatttcagcaacaatgacttcaagtctatccaatacagtccaatgggtaaccttccccatctgtgtggaaactccaccaacctccattatcttgatttgtcacataattatgatctgcttgtctataatctccattgggtttcccgtctttcctcattgaaatatcttaaccttggaggtgttcaccttcccaaggaaattgattggcttcaatcagtcaccatgctcccttctcttttagagttaaccttggagaattgtcaacttgaaaacatctatccatttcttcagtatgctaattttacttcactccaagttttaaatctagctggaaatgattttgtatctgagttgcctagttggttattcaatcttagttgtgacatctctcacattgaccttagccaaaatcgcataaatagccaactccctgaaagatttccaaattttagaagtattcaaacgttgtttttatctgataattatctcaaaggacctattccaaattggcttggacaacttgaagaactaaaagaacttgatctttctcataattctttttctggtccaatcccagaaggcttgggaaatctatcatccttgattaatctgatacttgagtcaaatgagttgaatggcaatcttccagacaatctcgggcatctcttcaacttggaaacacttgcagtttcaaaaaattccttgactggaattgtgtctgaaagaaatttacgttcattaacaaatttgaagagcttttccttgggttcacctgctctggtctatgattttgatcctgaatgggtccctccttttcaacttgtaagtatttcattgggctatgtgagagacaaacttccggcatggctattcacacagagttctctaactgatctaaagattttagactcaactgcttcatttgaacctcttgacaagttttggaactttgctactcaacttgaatatttcgttttggtaaacaacacaatcaatggagacatatcaaatgtgttgctaagctcaaaattggtttggttagattccaataatttaagaggtggcatgcctcgtatatcaccagaagtgcgtgttttgcgtatatataataactcattgtctggatctatttctcctctcttgtgtgacaacatgaaaaataaaagcaatttagtgtacttggggatgggttataatcatttttctggagaactcacagattgttggaataattggaaatcattggttcttattgattttggatacaacaacctaacaggcaacattcctcactccatgggctccttgtctaaccttcgttttgtatatctggaaagcaacaagttatttggggaggtacctttttcactaaaaaattgccagaatctttggatacttgatattggtgacaataatctttctggagttataccaagctggtggggtcagagtgtgagaggtcttaaattgagatccaatcaattcagtggcaacattcccacacagctatgccaacttggttccttaatggtgatggattttgcaagcaatagattatcaggaccaatacctaattgcttacataacttcacagccatgctttttagcaaagaattaaatcgtgtttatttgatgaatgacattgatctctcgaataacaacttgtctggaagtgtgcctttggagatttatatgctgactggattacaatccttgaatttgtcccataatcaattaatgggaacaataccacaagagataggcaacttgaaacaattggaggccattgatctctcaagaaatcaattctcgggagaaattcctgtgtccttgtctgccttgcattacctttcagtcttgaatttgtcgttcaacaatttaatgggcaaaatcccatcagggacccaacttggttcaacagaccttagctatattggcaattctgacctctgtggacctccgcttacaaagatatgcccacaagatgaaaaa

SEQ ID NO: 4457 - DNA, 1890 bp, Glycine Max
atgtgttcatgttttcatgcaacgcagttcattgacgtggcataccgattgaagatagaggacaaacaaaaaaacggaggcagcatcaagagattttttactccgcacgaatcatcaccgtcagatcaaggatcaagggcgggagcgtcgcaggagcgaactattttaaagggagtaacggggatagcacatccaggggagatcttagcggtgctgggcccatcggggagcggaaaatcaacgctccttaacgcgctcgcagggagactccacggacacggtctcaccggaacaatcctcgcaaactcgagcaaactcaccaaaccggttctccggcgaaccggtttcgtcacacaggacgatattctctaccctcacttgacggttcgcgagacgctcgtgttctgcgccatgctacggctcccgcgcacgctgccgcgcgcggcgaagatcgcagttgcggaggcggcgatcgcggagctagggctggggaagtgcgaggacaccataatcggaaacagcttcatccgcggagtctccggcggggagaggaagcgcgtgagcatcgcgcacgagatgctggtggacccttcgctcctaatactggacgagcctacctccggcttggactctacggcggcgcaccgcctcgtggtgacgctgggttcgctggcgaagaagggcaaaacggtaattacatcggtgcaccagccatcgagccgcgtctaccagatgttcgataaagttctggtgctatcggagggacagtgtttgtacttcggcaaaggaagcgacgccatgcgctactttcagtcggttgggttcgcgccgtcttttccgatgaatccggcagattttctgctcgatctcgctaacggtgtttgccatgtcgatggtcaaagcgaaaaagatagaccaaacataaagcaaaacctaatccattcatacaacacaatattgggtcccaaggtaacagctgcctgcatggacagtactaatgttccttcaagaaacacacaccctttgagaagcaactcttcaaaagaatttagacgtaacgacagggttagcttctttgattggttttaccaattcagaattcttctccagagaagcctcaaggaaagaaaacacgaatccttcaacactctgagagtctgtcaagttattgctgcagcactgttagctggtttaatgtggtggcactcagactacaggaacattcaagataggcttggcctactcttcttcatttccatcttctggggagtcttcccgtctttcaactcggttttcgcattccctcaagaacgtgccatcttcatgaaagagcgagcttctggtatgtacacactgtcctcctatttcatggctcgaattgttggagatctgccaatggagcttattcttcccacgattttcctcattgtgacatattggatgggtggattaaagcctgatttgtgggcttttctcttgactttgttggttgtgcttggatatgtgatggtgtcacaaggtcttggccttgctttaggggcagcaataatggatgccaaacaggcttccacagtggcagcagtgacaatgctagcatttgtgttgacaggtggatactatgtccataaggtgccatcttgcatggcttggatcaaatatatatccacaaccttctactgttataggctgctgactagaatccagtatgaggatggcaagaagatatcatatctattgggttgctatcaacgtgataagggtggttgcagctttgttgaagaggatgtggtggggcaaattggcaccctaggatgcattggggtgttgcttttcatgtttgtgttctacagattattggcctaccttgccttgagacgcatcaagagttga

SEQ ID NO: 4458 - DNA, 150 bp, Glycine Max
atgtgtttgcagttgtctgcatgcattgttattttcaaagtccgctttatcaagctgacaagtcaaataaattattccctctctcctagtagtgggggaatagatttgttcctgtatctgatcgaggtttttataatcgtcataatataa

SEQ ID NO: 4459 - DNA, 150 bp, Glycine Max; identical to SEQ ID NO: 4458

SEQ ID NO: 4460 - DNA, 564 bp, Glycine Max
atgttatctgctattgcctttggattctcagcgaattggtggttgcgctgtcacgggcgaacgcctcctcctttatcttttccggtttcagtgtcttattcttcctctttcaactccaactcaactaagttcaactatattcatagagcatcctctgaaggacttcctaatgagttggttgaagactcaaaatttgttcctttgaatgaggaggatcctatatatggtccacctattcgacagcttttgaaagagttggatggtgaattcctaaaggtcatctattgtactgaagacatgattatgcgttcgctttgggaggcaatgcatacaacacaacccaatgtagaagatgtcaagatagccaagtcacttcctcggatatgcttcttatctggtttaagtggagaggagatgatgatgttcatagattctttccccgaaactggactaaaaccagctgcatttgcggcacttgttccgaacagtgctaataaaccactggaggagttgatagatgaaataatgggagaccatgagatgttgactggagaacagctatga

SEQ ID NO: 4461 - DNA, 606 bp, Glycine Max
atgttatctgctattgcctttggattctcagcgaattggtggttgcgctgtcacgggcgaacgcctcctcctttatcttttccggtttcagtgtcttattcttcctctttcaactccaactcaactaagttcaactatattcatagagcatcctctgaaggacttcctaatgagttggttgaagactcaaaatttgttcctttgaatgaggaggatcctatatatggtccacctgccttattgttgttgggctttgaagcagatgaagctttgaagattcgacagcttttgaaagagttggatggtgaattcctaaaggtcatctattgtactgaagacatgattatgcgttcgctttgggaggcaatgcatacaacacaacccaatgtagaagatgtcaagatagccaagtcacttcctcggatatgcttcttatctggtttaagtggagaggagatgatgatgttcatagattctttccccgaaactggactaaaaccagctgcatttgcggcacttgttccgaacagtgctaataaaccactggaggagttgatagatgaaataatgggagaccatgagatgttgactggagaacagctatga

SEQ ID NO: 4462 - DNA, 516 bp, Glycine Max
atgttatctgctattgcctttggattctcagcgaattggtggttgcgctgtcacgggcgaacgcctcctcctttatcttttccggtttcagtgtcttattcttcctctttcaactccaactcaactaagttcaactatattcatagagcatcctctgaaggacttcctaatgagttggttgaagactcaaaatttgttcctttgaatgaggaggatcctatatatggtccacctgccttattgttgttgggctttgaagcagatgaagctttgaagattcgacagcttttgaaagagttggatggtgaattcctaaaggtcatctattgtactgaagacatgattatgcgttcgctttgggaggcaatgcatacaacacaacccaatgtagaagatgtcaagatagccaagtcacttcctcggatatgcttcttatctggtttaagtggagaggagatgatgatgttcatagattctttccccgaaactggtaacaaaaacatgatcacatcctga

SEQ ID NO: 4463 - DNA, 624 bp, Glycine Max
atgttattggcagtagaaggaggaggattcttctctgcttcggcttcagggtatactaagggcctgagccttctcctcttgggtcagaggaatgaggataaacccatgagagtagcgccgtggaaccagtatcagttggtagaccaagaatctgaccctgagctccagctggcttccacaaagaatcgcctctcccgcggctgtgcctcctttgtttgctttggtcgcacttccgcaggacttgatactccgtctcctcttaaagtgggccctgctcaacaacatgatgtctcaccagggccactggtttccaacaagggaaaggatccttctgcacatgtagatgatgaaagtgataacagaaaggctacactaaaaagtagcataaagaagccacaaaatagaaaatccgttcctgttgaggttgctaatgaacatgaagcatcaagtggacaggggatttgtactcctggaggtcaacccgaaagaaggaaagtgcagtggacagataattgtggtagtgagcttgtggaaattcgagaatttgagcccagtgaagtggatggatcagatgatgaatttgatagtggaaatgacagaacttgttcctgtgcgattatgtaa

SEQ ID NO: 4464 - DNA, 381 bp, Glycine Max
atgttcgcaatgacctccatcaagggtattggaaggagattcgccaacatcgcttgcaagaaggctgatgttgacatgaacaaaagggctggtgagttgactgctgctgagttggatagtgtgatgactgtggtggcgaaccctaggcagttcaagatcccagactggtttttgaacagaaagaaggattacaaggatggcaaatactctcaagttgtgtctaatgctcttgatatgaagctcagggatgatcttgagagactcaagaaaatcagaaaccaccgtggtttgaggcattactggggccttcgtgtccgtggtcagcacaccaagactactggccgtaggggaaagactgttggtgtctctaagaagcgttaa

SEQ ID NO: 4465 - DNA, 276 bp, Glycine Max
atgttgagtcagaaaaatgttggtgaggtcgtaatgttcttcctcaacggtgagacgtacttgggcccaagttgctgccaggccataaagatttcgggccatgattgttggcccaacatgcttgcctcagtgggtttcacctctgaagagggtgatattcttcagggctattgtgacactgaacaggaacaactccattctcctccatctcccacgtcaccaaccactgttgttcatgagctagtcttgtgccttggtttggactttggtcaataa

SEQ ID NO: 4466 - DNA, 678 bp, Glycine Max
atgttttgggtggaaaccgatgaaaaccgcaacacccttccctctcctctcccacataaaacccacaagccccttcttcccattgggtaccgcagaggcatggccaagaagagaaaatccatatccacaagcctcgacgaggtggatcgaaccatctactcttccttctccagtgccgccaattccctctctcacctctacactctctccatgaaccaccagaaactctccttccaagccggtgaacgccactcccttgaaaaactctatcagtgggtctggaggcaacaagagagtggatcaagagttgcaactgttgatatactcagctacattcagaatgagctggattactgtggagaggagccatgcatgtcccctagagctccactgcatcaacaacagtcacaaccggtaatgcaagtcactactggtgcaggttttccagtaactacaggattttctggccaaactattgtggggcaggaggtcagacctgagcactgtgataatcaatcaaagaattctatgttttcaaatgctttgtcaaaccctgttcgtcaaattggtgagggagggaaccacccaagtggtctttccatggggaatggaaaccagagcaccgactctgctgctttcagttccaatgattctgccatggacatgcatgcagactag

SEQ ID NO: 4467 - DNA, 396 bp, Glycine Max
atgtttttcttaaccttctccatactagcagctgttctgggcatcgtgtccaaacttttgggtgggaatcacatgaggacatggaggagtgacagtttagcatctgcaggagccacatcaatggttgcttgggcagtcacagctctagcatttgggttggcttgcaagcaaatacacttaggagggcatagagggtggaggctgagggtagtggaggcattcataataatactaacattcacacagttgttgtacctgatactgatccacgcggggctatatagcagcagatatggtcccgggtaccatgacactgactatggtcatggacatggtgtgggagggactacaggagatccaatgcacaagcctgctactgcaggaactcgtgtctaa

SEQ ID NO: 4468 - DNA, 93 bp, Glycine Max
atgttttttttttttaagttgcatatgatatttttctcttttttatattacttttactctcttttgttaacattgttaaataatgttaattaa

SEQ ID NO: 4469 - DNA, 668 bp, Glycine Max
caaaccctaattcaaaagcgtattcttcaaaagacgaagattaatttgtgccagtctcactgttgtgcaaatatattggttcctgcagaatcagacaacagatatcacagggtaagaggagcaattgctacccttgaacaagaaccttcctctagaaactggcttcttgcagtgaagaaagatgcattgacatggtgcactttcaattcagaaaaatctatgatgtcctccacttcaaaaaagtacaataatcgaagatttttcttcttggacaatgggtggaggcttgaatttgctagtaataaagattggaaggcctttaaggccctttataaggattgttttggtcgtaatttcgcagttcgtgatgccaaagctatatctatacctggtgttagagatgcctctgactatgaagaaacttacagtgctccctttcataggccaaaggtttatatatctcgaaaaggtgatgatcagctttttagggctgtcacatggaagagtagtgcaaactatgacatggattctgaagatgaaaagtggctcagcaagttcaataatattaataagaagaataaggagcttcttatctttatccagatgtttattctaatgcaaaatctgcttctgatcggtttcctcatggtcttgctaacaaggaagtt

SEQ ID NO: 4470 - DNA, 2070 bp, Glycine Max
cagtgcaatgagaaggacacgaacacactcctacacttcaaacaaggagtcactgatccctcaggcttgctctcttcatgtttccctgagctagattgttgtcactggacaggagttaagtgtgacaatatcacaggtagagttacacagcttaacctcccttgtcatataaaccatcctaaagttgttgattatggagagaaggatgacaaatcaaactgcctaacaggtgaattcagccttaatttgctggaacttgaatttttgagctacttgtcaagagtgttgcacttggagagttgtcaacttgaaaacatctatccatttcttcagtatgctaattttacctcacttcaagttctaaatctggctgacaatgattttgcatctgagttgcttcaaaatgagatacatagccaactacctaaaacattgccaaatcttagaagtgttaagtccttgattttatctcataattatctcaaaggatccattccaaattggttaggacaacttgaacaactacaagaacttgttctttctgataattttttttctggtccaatccctgcaagtttgggaaatctatcatccttgattgaattgatacttgacttaaatgagttgaatggaaatcttcccgacactcttgggcaactcttcaactcggagacacttcgagtcggaggaaattccttgacaggaattgtgtctgaaagaaatttactttcttttccaaaattacagcgcttgtacattggttcgcctgacctgatctttaattttgaccctggatgggtcccttcgtttcaacttctacgcattggattgggctatgtgagagaccaacttcctgcatggctattcacacagacttctctaaaatatctatccattctacactcaactgcttcatttgaacctcttgacaagttttggaactttgctactcaacttgaatatatcgatttgacaaacaacacaatccacggggacatgtcaaatgtgttgctaagctcaaaatttgtttggttagcttccaataatttaagtggtggcatgcctggtatatcaccacaagtgactgttttaaacttaggcaataactcattgtttggatccatttctcctctcttgtgtgacaatatgacagataaaagcaatttagtgcacttgagcttaggtcataatcatttatctggagaaattacaagttgctggaataattggaagtctttggttcttattggtttacaatccaacaacctaacaggtaagattcctcactcaatggggtccttgtcaaaccttcgttttttgtatctgggaagtaataaattcttcggagaggtacctttttcactaaaaaactgcaagaatcttagaatactcgatcttggtcacaataatctctctggagttataccaagctggttgggacagagtgttaaaggtcttctgttaagatccaatcaattcagtggcaacattccaacagagctatgccaaataaattccataatggtgatggattttgcaagtaatagattatcagggtccatccccaattgcttacaaaacatcacagccatgatttctagttatgcttcaacgcgtagagtcgtctttaccgttaacttaacaggtataccagtacacatttattgtaatatttggatgcttataaaaggcaacgagttagcatacgttgatttgatgaatgtgattgatctgtcaagtaacaacttgtctggaagtgtgcctttagagatgtatatgctaactggattacaatccttgaatttgtcccataatcaattaatgggaaccatattagaagagattgacaacttgaaacaattggaggctattgatctctcaagaaataatttatcaggcgaaattccagagtccatgtctgccttgcattatcttgctgtcttgaatctgtcatttaacaattttgtgggcaaaatcccaacagggacccaacttggttctacaaaccttagctatatcggcaatcctgacctttgtggagctccacttacaaagatatgcccacaagat

SEQ ID NO: 4471 - DNA, 2581 bp, Glycine Max
cgagaaacttgcttgcaggttctctctctctgcaactcacaaaccctgaaggagggagcatgtgttcatagcccaattatcaaagtgggtcttcaacatgacttgtatttgagcaacaatttattgtgtttgtacgccaaatgctttggagttggacaagcacgccatctcttcgatgaaatgcctcatagggatgttgtgtcgtggactacactcctttctgctcacaccaggaacaagcatcattttgaagctcttcaattgtttgacatgatgcttggttctggtcaatgccccaatgagttcaccttgtccagtgccttaagatcgtgttctgccttgggagagtttgagtttggggctaaaattcatgcctctgtggtaaagcttgggttggagctgaatcatgttctgggtaccactttggttgatttgtacaccaagtgtgattgcactgtggaaccacacaaattgcttgcgtttgtgaaagatggtgatgttgtatcttggacaacgatgatctcttcattggtggaaactagtaaatggagtgaagctctacaactctatgtcaaaatgattgaagccggtatttacccgaatgagttcacatttgttaaactcttaggcatgccttcttttcttggtttggggaagggttatgggaaagtactgcattcacagttaatcacatttggtgtggaaatgaatttgatgttgaagacagccattatttgtatgtatgcaaaatgtagacggatggaagatgctattaaggtctcacaacagacacctaaatacgatgtgtgcttatggacttccataatctctggatttgttcaaaattcgcaggttagagaggctgtcaatgcattggttgatatggaattgtctggaattctaccaaataattttacgtatgctagtttattgaatgctagctcctcagttttatcattggagcttggggaacagtttcattcaagggttatcatggttggattggagggtgatatttatgtaggaaatgcattggttgatatgtacatgaaatgctcccataccacaacaaatggtgtgaaagcttttagagggatagccttgccgaatgtcatctcttggacttctttgattgctggttttgcagaacatggttttgaagaagaatctgttcagttgtttgctgagatgcaagcagctggagtgcaaccaaattcctttacactatctactatccttggagcttgcagcaagatgaaatctattattcaaacaaagaaactccatggatatatcataaaaacacaagtagacattgacatggctgttgggaatgctcttgtagatgcttatgctggaggggggatggcagatgaagcatggtctgttattggcatgatgaaccatagagatatcatcacatacacaactttagcagcaagattaaaccaacagggagatcacgaaatggcattaagagtcatcactcacatgtgcaatgatgaggttaagatggatgaatttagcttggcaagttttatatcagctgcagctggcttaggcattatggaaactggaaagcaactccattgttattctttcaaatcaggtttcgagagatgtaactcagtctcaaatagcctagttcactcgtacagcaagtgtggtagcatgcgcgatgcatacagagttttcaaagatataactgagccagatagagtgtcatggaatggtttgatctctggattggcatcaaatggacttatatccgatgctctttctgcctttgatgacatgaggttagcaggagttaaacccgattctgtcacattcttatcactgatttttgcttgcagccaaggtagtttattgaatcagggtcttgattatttctattccatggaaaaaacatatcatataacaccaaagttggatcactatgtgtgtttagttgatctcctcggtagaggtggtcgcctagaggaagctatgggagttattgaaacaatgcctttcaagccagattctgtaatttataaaaccttattaaacgcttgcaacttacatggaaatgtgccactgggagaagatatggcaaggagatgtctcgagcttgatccatgtgaccctgcaatatacttgctgcttgcaagcttgtatgacaatgctggactccctgattttggtgacaagactcgcaagctgatgagagaaagaggcttaagaagaagtccaaggcagtgttggatggaggtaaaaagtaagatttatctcttctctgcaagagagaagataggtaatgatgagatcaatgaaaagctagagtctcttataactgaaataaagaatagagggtatccataccaagagagtgaagacaagttataccactcagagcaattggcccttgcatttggtgttcttagcgtgccaactttggctccaatacgcataaataaaaactcacttatctgcactcactgtcattcttttataatgcttctgacacaatttgttgatagagagataattgtgagggataggaaacgattccatgtctttaaggacggccagtgttcat

SEQ ID NO: 4472 - DNA, 843 bp, Glycine Max
cgtcgcatttgccgccaccaatggcttccctctctccgccaaaatgtacggctcctacgaggtcctcaacgtggacgctatctacatcccactccccaccagcctccattttcactgggccgtgcttgcggcctagaacaaaaaccacttgctcctggaaaagcccgtggcgctcgacgtggtacagttccaccgcattctggaggcctgcaaatccagtgtggggtgcagttcatggatagcaccatctgggtccataacccaaggactgctaccatggcccacttcctcaacgatgcgcaacgttttggtatcctcaaatcggcattcatgaaaggatacgaagcatttatcagttattcatttaagagaagtcggatcttgatgctcttggttctctgggtgatgcaggatggtattgtattagggcaatcctgttggctaccaactacgtacgaattacctaaaacagtagttgcttcatatgaacctgtgcttaacaaagatgtggtgatattggactgtggggcttctctatactgggaagatgggaaagtagcaaccttccattgctccttcttggcaaacttaaccatggacataacagctattggcacaagaggaactctgcatgtgcatgattttgttatcccttatcatgagaaggaggcatcatttttggctggtacagaaaccggctttaatgatcttgtcacagggtgggataaacaaccaagtaagaatacagtgaccactgatctccctcaggaggctcttttggttaaagaattcgccggttggtcggagaaatcaaattcaaaaactccaagcctgacaagaagt

SEQ ID NO: 4473 - DNA, 222 bp, Glycine Max
ctacatatcatcaacttcagaaagaacaaaaccaatcatcacaagaaatatttattcattgagagagatatgatgcaagaagacatcagctcctgcactagacatgtctgtgaacccttcaaatcctttggaaggagatgcactaggcttggtaaggagcaaagggcaaggttctatatcttctggaggtgcatcacaatgcttgtctgctggagagaatga

SEQ ID NO: 4474 - DNA, 515 bp, Glycine Max
ctagcagtgtgttcagatgctagtgggatagctgtgtgcttgggccaaaatgggattgagggaatcttagaagaaacttccgcatatgacaatggcacgactcccagctctgaaccttgcaggccatattctgagattaggtcatgccaagccaataacatcgagttgccatgtacttgtggaacaacttcttgggtggacaatcctgttcgcggccccttggcgatgctgctttggatggaattgattttgtcattgagggaggaaaggttcagtactgggatgaacttggctctaagattaagaaaggaaggaaagaacacttgtggaattgaggggatgattacaaatggcatgagatgtaagatggctggtaataaaacctcatcttggatacaccaaaatgcaactttcagagctctcgttacctcttcttcatcaactgccccatttaatcttttatctgccaccttaattattgacccatttgtcatctcctgcaataaccaaacact

SEQ ID NO: 4475 - DNA, 102 bp, Glycine Max
ctcaagtgcgtgggggtggcaatggcacttgaagccttagaatgggcttacgtacggagaaaatgggtttttcgttttccttggatacatacaagactataa

SEQ ID NO: 4476 - DNA, 220 bp, Glycine Max
ctcccatctgaaatctcagcaaacaactacatctactcctctcctccacctcccaagaagccttaccactacccatctccacctccaccagttccttcaccacctccacctaaggctccttaccactacccatctccgccaccaccaccaaagaagccctacaaatacccatcaccaccacccccagggaagcaaccctaccctgacccccacccccacc

SEQ ID NO: 4477 - DNA, 564 bp, Glycine Max
cttactgtgtggaacatgaagacatggaaagccatgacagtccttcctcttggagaagatccaccagcaattacttctctatgctttaatcacaatggaaagattttggcagcttctgccgttgatggaatgattcacatgtttgtcgaagacatgtctgctggtctacaaatcactggctggccagcacatgattcttccatcagttctattctgtttggaccagatgagactagcatttttagcctgggctctgatgggaaggcaatttgcaaaatcaaggtcaaatcctgtggtcgagagactctagctagtaggttctgttaccccctcaatgattcaaaatattgcagacatgagatggcattagatgcaaatgggaggagactcttggtaacatccagttcatttagagcacccatataccaggttcatggtcatttgagtggatggagaacacttccgcacggtgctcctattactgctgtggattggcatccgaccctgcccattttcttgactggatcagctgataactctgtccgagtaacatctttatcatag

SEQ ID NO: 4478 - DNA, 540 bp, Glycine Max
gaaaaggctaagtactattatgttgctggatttttcctcaccgtgtcccttgagtccattaaaattcttgctaggaatgcagctgcgaataataagttacatcaatcattatctgtttttactttagtgacattgatcgaatccttacacacttttacgtacagggatgagcaggatcaaattatgccgtatattgactatgtatttgtttatggggttgaggctagaaccttttcacaggcgcatggctggaagactgataataatgttatcattcaagatccagttcttcccgttgtactggctgaggatggaaagatcaaattattctcagctgttccactgccaaaagagaagattgtggataccaatggagtagcggacgcatttgttggtggattcttgtcacagctggttcaagaaaaggccattgaggagtgcgtgaaagctggttgctatgcagcaattctcatagtttgtcttgtgtcacacccagtgtgtaagatcagcatggcccttccaaaatggcctaggatgtga

SEQ ID NO: 4479 - DNA, 238 bp, Glycine Max
gcagcactagacttggtcacacccaattctttcgacaacaactacttcaagaatttgattcagaagggtcttcttcaatcagatcaaattcggtttagtggaggatctacagattctattgtgtccgaatacagcaataagcctacaacctttaagtccgacttcgcagctgctatgattaaaatgggagatattcaaccattaactgcttcagcaggaatcataagaaagatttgca

SEQ ID NO: 4480 - DNA, 156 bp, Glycine Max
gccagcactggtggcattgccatctactggggccaaaacaatagcgacgacaccttgagttccacatgccacactgccaactacgagattgtcaacctagctttcctcagtgtgtttagttgcgccagaactccatcatggaacttcgctggccac

SEQ ID NO: 4481 - DNA, 673 bp, Glycine Max
gcttcttctgaagatggagattccaaagtgtatcttcctgaccttggaaagggcttgggttgtgtaattcaaacaagggacggaggctacttggcatccatgaaccctttggatgttgctatggctagaaaagaagctccaaagctagctatgcagatgtcaaggccttttgtgttggcatcacgccaatccttgacagggttcaagttgtttcagaaattggctggcattgaatttgatgaactcaactccaaggttttgcccttaatgcccatagatgaaatgataggcaaaactgcaggacatgctgcttttgaaggcattgctaatgcaatcatacaaggtaggaacaaggaaggatccagttccagtgctgctagaatattttcttacttgaaaagcatgggaagtgccatgaaggagtcactcacaacagagaagcttctggcgtttgccatgcagaaggttgagtccatgacagtcaaaacattgaaaattcaagctgacatggctgaggaatggatcagagaccacagctatgctaaaaaagatccaatgagatgctatgaagtagttggaggacctgtgatggtgctgatttatgcaacaagtgctgacacaaaagggaaggaagaggagaaaaggttcaaggtaacaagcatgcatgtggggg

SEQ ID NO: 4482 - DNA, 1111 bp, Glycine Max
ggttaccccactaatcaagacttcgactatgatgcactagcaccgttattgcattttcacctaaacaatgttggtgatccatttacagagagtagctttagtttaaattcatcaaaatttgaagtttgcgtgcttgattggtttgctaacctatgggagatagataagggtgagtattggggatatgtcacaactggtggaactgaaggaaatcttcatggaattttaacagggagggaacagtttccagatggtattctatatacttcacaggattcgcattattcaatatttaaagcagcaagaatgtataggatgcaatgtgtgacagttggcactttggtctctggtgagattgattgtgttgatttaaaggctttacttcttgctcataaggacaagccagccatcatcaatctgaatataggaacaaccatgaaaggagctattgatgacattgatcttgtagtgcaaacacttgaaggaagtggcttttcgtgtgatcaattttacattcattgtgatggagctttatttggaatgatgatgccatttcttatacaagctccaaaggttaccttcaagaagcctattggaagtataaccatttctggccataagttcctgggatgcccatttccttgtggtgttttaataactcgtttggaatatatcaacacattagctaaaaatgttgaatatattgcttcaagggatgtcacaatcacaggaagtcgtagggggcatgctccaatttttctctggtatgcactcaaagaaagaggttcagtaggactccaaaatgaagtacaaaaatgcataattagtgcacgttatttacaacatcgacttcgtgaagccaaaattggtgcaatgttaaatgagtttagcaacactgtcgtctttgagaggcctcaagatgatgacttcgctcgtaagtggagcttagcatgcaaaaaaaatattgcacatggggtggtgatgcaacatgttactgttgagatgttggactccttcgttaatgaatttattcaggaacgacaaatttggtttcaagatgatggtaagagaaatcccctatgccttgcaaacgacattggtgttggaaatt

SEQ ID NO: 4483 - DNA, 1029 bp, Glycine Max
gtgaaggaacgtagagatgacccaaaaagcatcaacttccatgaggagtacaatagtgtattaaggacaaaatcctatgttaatttcttcaataaagttcaattacttgcaaaccaaccttcctctaatgacaaccataacaaattttcagaaatcctccttgaaccttgccaagaaactataacttccattcttgattcagcaaccctttcaatgacaccagaactcaaaaacctcatgctcagttactttgacattagtgcagaggcctcacagatttgctgtcatcttctcaaaagcatcaaccaactccactccaattatcagtttattcaaagggcactagacattatggatggcgactctttggaaacttttgacctaatcaccttcgggcttaactcattcaattactcaaataaccctttttcaaaccttaaaaaccatgacttcaagctcatcactgataagctctcatcaatattgcaccatctaaagtcaatgagaaaaaaagtgggaaggaaaattaagcttatgaagtatttgaagaatacatctgaggtttgtgtcacagcagcttgtggcatagtggcaatcacagccatggttatagcagcacatactctaacagcagttattatgggaccagcaattcttagttttccatttaagcattttaagaggaagcttagagcctatgaattttcaggaaaagggtctcagagtaaagtttatgatcagcttggtatagcagcaaagggaacttatatattgaatagagactttgacacaatgagtagacttgtagctaggcttcatgatgaaattgagcatagcagggcaatggtgcaattatgtttggacaggaaagaggacaaattctctttgcaggtggtgaaggagcttaagaaaagtgatgttcggttcaggaaacaagtggaagaacttgaagaacatgcgtgcttgtgccttgtagcaataaaccaggcaaggaccttggtagttaaggaaattaaaagatcgatgtga

SEQ ID NO: 4484 - DNA, 1602 bp, Glycine Max
gtgagagaggccaattatacgagactctgttcgacaaaaagcatattgacagtgaatggaaattttccaggaccaactatcaaagtccacagaggagaaacaatctttgttaatgtttataacaagggcaactacaatatcactttgcactggcatggagtgaagcagccaaggaatccatggacagatggtcctgcatacattactcagtgccctatccaacctggaaggagattcagacagaagttgattttttctacagaggaagggaccatatggtggcatgctcatagtgactggtcaagggccactattcatggggctatctatgtctatccaaccaagaatacaccttacccttttcccaaagctcatgcagagattcccatcatatttagtgaatggtggaagagtgatattaatgaggtcttcacacaatttattgaatctggaggaggtccaaatatatctgatgctctcacgataaatggtcaacccggggatttgtacccttgctcaatgacagaaacgttcgagtttcatgtagagcaaggcaggacttatcttctccgtgttgtcaatgcggcaatgaatctcattcttttcttctctgtttcaaaacacaacctcactgttgttggtgctgatggtatgttaaccaagccattgacaagggaatacatttgcatatcaccgggacaaacaatggatgtgttgttgcatgccaaccaagaacctgatcactattatctggctgcaagggcatattcaagtggtgttggtgttgcctttgataacacaacaaccactgctagagtaaagtacagtggtaattacactcctccttcatctccttcattgcctaaccttccagactttaacgacacgcctgcggtgttggacttcattacaagcttgagaggcttacctgagagataccctcgccaggttccaacaaacatcacaactcaaatagtgaccactatttctgttaacactttgccatgcccaaatggcagaacctgccagggaccaaatggaaccattttcgctgctagcatgaacaacataagttttgacacccccaacattgacatactaaaagcttattactatcatatcaatggggtatttaaaccgggatttcctagatttccaccctttatatttaacttcactggggattttttgcctataacattgaatataccaaagcaagggactagggttaatgtactgaattatggtgcaacggttgaaattgtattccaagggacaaacgttattgcagggatagaccatcctatgcatctccatggattcagtttccatgttgttggatatgggttaggcaatttcaaccaaagcaaggaccccaagaatttcaatctcgtggatcctccttatttgaatacagtgattgtgcctgtaaatggttgggctgctgttaggtttgtggctaccaaccctggagtatggttcatgcactgccatctggaacgccaccaagtttggggcatggagacggtgtttattgtgaagaatggaaaggcttcaaatgaaacgttaccaccaccaccgccagatatgcccctctgttga

SEQ ID NO: 4485 - DNA, 420 bp, Glycine Max
gtgctaggtgtcttaacagttcagccagataacaattttgagtctgaaaataaggattatgcagcaagtcaggaagctcccttgaaaacaaagaaatttttttgtgacaggaaattgtcagtagtcagatggtatttgtttctatttttcatgtttaggctatcattttatacatctgagaaaaccttgcgtgcagcatttgaaggctttggcgagttagtcgaagttaaagttattacggacaaaatttcaaaaaggtccaagggttatgcatttgttgaatacaccacagaggaggctgcaagtgcagcactcaaagagatgaatggcaagattatcaatggctggatgatagtggtagatgctgccaagcctaacccaccaagatacaacaggaatcgtgctggatcatcaagttga

SEQ ID NO: 4486 - DNA, 981 bp, Glycine Max
gtggaaggggctaaaaggtcttatggggtatacaacagcaaccctgtaaaactgtttgtttttggggactcctatgttgacactgggaatttcgtgcattcagaatcatacaagcctcccagtggaatcacttttcctggtaaccctgcagggagattctgcgacggtcgcatcatcactgattacgttgcttcctttctgaaaattgaatcccccacaccatatacttttagaaattcatctaatcttcactacggtataaactttgcctatggagggaccggtattttcagtacttcgattgatggaccaaacgcgactgcccaaatcgactcatttgagaagctaatccaacaaaatatctataccaaacatgatcttgaatcctcaattgctctcgtcaatgccggtggtaatgattatacaaatgcattaaaaactgggcgcattattgatttaccaggcttcatggaatcccttgtgaagcaaatgtctgtaaatcttaaacgcattcgcagcttagggataaaaaaggtagcagttgggttattacagccaattgggtgtttgcctgtgttaaatgtgatatctttccgtacgaactgcattggccttttgaacgtgatctccaaagatcacaacaaaatgttgctcaaagctgtgcaagaactcaacaaggaagcagcagacaaatcagttttcataacactggacctctacaactccttcctctctgcaattgaaactatgcagaaaaagcgtgcagaaaagtctacactgatgaatccgttgcaaccatgctgtgagggaaacaatttggaagattcatgtggaagtctggatgacgaaggatcaaagaaatacagtttatgtgagaacccgaaactttctttcttttgggacacacttcacccttctcaaaatggttggtttgcagtctacacaatattgcaatctactcttggccaacttattacatga

SEQ ID NO: 4487 - DNA, 1047 bp, Glycine Max
gttccaatcacagaatcattcgaaaacaccaactacgactttgagtgtctcaaagacacgctccctgaaaaccctaacatctaccacttctctgagatctccgccgcaaccgccaatttctccgcgccacgcctttcctcttcctcctggcgctgcgtaattcgtcaccgcgaagtcgtcgtttcgcgccgcgacttccgccgtcaaattgatatcccggagctcagccgccgcctcgccctcatctgccggagtcaccacagcagcctcttgaaactcctcggcgcgtcggtctctggcgccgtcatcttcctcgtcaacgagttcgtccccggcgccagcctcgccgactgcctccgcaaccgccggaaccctagcttcaccgatctcaacacgtggatctctcggatgcagatcgcgtccgacgtggcgcacggtctcgattacatccacaatttctctggttccggttcggattccggttccggatcaggatccggattcgttcacaagcacatcaagagttcgagcattgttatcacggaggagaatctgcgcgcgagaatctgccacttcggcgtgtcgggtctctgcggcgaggccgtcgccggcgacggcgatccttctggcggccggactgtgaggatcgaggggaggagaggctacatggcgccggagtttcagatcagcggcgtcgcgacgaagaagagcgacgtgtacgctttcggagtggtggttttggagctgctgagcggggaagaggcggtgaagttcgaattcaacgacgacggcggttatcgcaggattagcgtggtggagacggcaaagattgcggcggaggagaacggcggcgtgaggaagtgggtggatacgaggctgagggattcatttcccgtgaatgttgcggagagaatgattcgggtcggattggaatgtgtcggggatgacccgaatgagagacccgatatgggttgggtttctgatgaggtgtcgaagttgtatttggatctcgttggccccacggtgacttcttttggttgggtttga

SEQ ID NO: 4488 - DNA, 1032 bp, Glycine Max
tacagcgccgagtactggatcacaggcgacctcatcacccctccccagcaccgcgccaattcctttaccaaacgcgtcctggacccgcttctcgccgacgtcgttttcgtccccttcttcgccacgctcagcgccaacaaaggcgccttcagaaagaagcacgggaacgacgattacaagcggcagaggcaggtcgtggacgccgttaaatccacccaagtctggaaccgctccggcggacgtgaccacgtgtttgtgctaaccgcgttgtttggcagacccggtggcgattttggtggttggtccagaggtggtggtggttcaaactgtggcgagagtgatgtggttccgcacacgcaagtttctgtgattaaagatgtcattgtgccgtacatgcatctgctgcccagattggatttgtcggaaaacaaggtccggcaccagcttctgtattttaaaggagctaaacataggcaccggggaggtataatcagagagaagttatgggatctattggttagtgaacctggtgttataatggaggaaggcttccctaatgcaactgggcgagagcaatcaattaaagggatgagaacatcagagttttgcctgcatccagctggggatacacccacttcatgccgactttttgatgcaattcaaagtctttgtatacccgtcattgtcagcgacatcatcgagcttccatttgaaggtatggtggattatgcagaattttctgtttttccagcagttaatgatgcccggaaacctagctggctaggcaatcatcttcaaagcttttccaaagagcagaaagacaggttccgccaaaatatggctcaggtacagcccatctttgtctatgataatggccatccaggtggtattggaccaatacctgtggatggtgcagtgaatcatatatggaagaaagttcaccaaaaactgtcaatgataaaagaagccataattcgagagagaagaaaaccacctggtgcgtcagttccaaggcgttgtcattgtacttga

SEQ ID NO: 4489 - DNA, 1020 bp, Glycine Max
tatcctactaatcaggacttcaactctgatgcaataaaaccattatttcattttcacccaaacaatgctgtttgtgtgcttaattggtttacaaatctgtgggagataaagaagaatgagtattggggatacgtcacaactggaggaactgaaggcaatcttcacggaattttagtggggagagaacaacttcctgatgggatattatatacctcacaagattcacattattcaatcttcaaaatagctagaatgtatcgaatgaagtgcatgaaggttagcacattaacctccggtgagattgattgtgttaatctgaaggatttagttcttacacacaaagacaagccagccattatcaatttaaacatagggacgactatgaaaggagctattgatgaccttgatcttgtaatacaaacgcttgaggaatgtggtttcactcgtgatcggttctacattcattgtgatggagctctatttggaatgatgttgccttttgtcaagcaagcaccaaggattaccttcaagaaacctattggaagtgtgactgtttctggccataagttcttgggatgcccaattccttgtggtattgcaataactcgtttagaatacatcaatgcattgtctaaaaatgttgaaattattgcttcaagggatgccacaatcacaggtagccgttgtgggcatgctccaatatttctttggactccaaaacgaagtgcaaaaatgcataatgaaagcacggtatttacaaaatcgactaccgacattgtcatctttgagaggcctctagatgatgactttattcgtaggtggaatttggcatgcaatgggaatattgcacatgtagtggtgatgcaacacattaccattgaaatgttggactcctttggtggtgagtttcgtaaaaagcgatccttttggtttgaagatggacaacttcaacctctgtgcattgcaaatgacattggttctagaaattgtgtctgttcaatgcaccgttcactatcatga

SEQ ID NO: 4490 - DNA, 303 bp, Glycine Max
tcccccaaaacccaatcatatcatttcatttcttcctttgtcgtccatcccgtaaccatgtctcagactgttgtcctcaaagttggtatgtcatgtgaaggatgtgttggagcagtgaagagagttctaggaaaattggatggtgtggaatcatatgacattgatttgaaggaacaaaaggtggtagtgaaaggaaatgtccagccagacacagttctgcagaccgtttccaaaactgggaagaagactaccttctgggaaggtgaagcagcaacatctgaaactagcacagcaactgcctaa

SEQ ID NO: 4491 - DNA, 1335 bp, Glycine Max
tctaagaaagatccaatcttgggctatacccacttcacacttcgctccaggagtgatgggtttgatggcttttccactgatgtatctcaagatgatggaacaagccaagaacttgaacagcttgagttgctgaacaagccttcaccagtgcttgttaccgaagagtcttcttctgaggttgaagtggaggaagagaaaccctccaaggaggaggctttggcacctttcttgaagtttttcaaaggcaaagattctgggcaggaggttgaggaagatgagggagataagaaggttagtgttgagtactatgagcccaaacctggggattttgtggtgggtgttgttgtttcaggtaatgaaaacaagcttgatgtcaatgtaggggcagacttgctaggtacaatgttgaccaaggaagtgcttcccttgtatggtaaggaaatggagaacttgttgtgtgatgtggacaaagatgctgaggattttatggttaatgggaagatgggaattgtgaagaatgaggaggcaataagtggagtgccagtgcctggaaggcctgttttggagatcggaaccattttgtttgctgaggttttaggtaggactcttagtggcaggccattgctttccaccagaaggctctttcgccggattgcctggcatcgagtgaggcagataaaacagctcaatgaacctatagaggttagaattactgagtggaataccgggggcctgctaacaaggattgagggtttacgagctttcctacccaaagctgagcttgtaaaaagagcaaatagctttactgaattgaaagaaaatgtggggtgccgtatgtacgtacaaattactcagatagatgaaactaaaaacaatttgatacttagtgaaagggaagcttggcaaaaattgtatcttcgtgagggaacacttctagatgggactgtgaaaaagatcttaccgtatggagcccaaattaagctaggaaaaactaatagaagtggattgctgcatgtttcaaatatctctcgagctgaagttacttctgtcagtaacatactttctgttgatgagaatgtcaaagctcttgtggtgaagtcaatgtttcctgataaaatttctctgagcattgctgaccttgagagtgaacctggcctttttctatcaaataaagagagagtatatatggaggctgatatgatggcaaagaaatataagcaaaagctaccaccttctgtcaccactcaaagattagaacccctaccaaccagtgccttgccttttgaaaatgaagcactttattccaactggaagtggtttaagtttgaaaaataa

SEQ ID NO: 4492 - DNA, 531 bp, Glycine Max
tctaataagagaaaaaaggatggctcaacgtcgtgttctctaaggaagaacagaagatcttctattgctggtgagggtgaggaggataaaggtggtaaaacctcaaggcagctgagaaaacaagcagctcgtaaacctgcaaacagttcattcaatgaggatgttgaagataataatgaccttgaccctccttataattctaatggagatgaacttcaagaaaatgacgagactatgaagctgattatccatccaagaaaaaaagagtatcaacaagttcacagaagaaatttgtggctaaaagctaatgatgatttagaaaaaactgaggaacgtcccaaaaagttctctcattcgactcgacgaagaaaaagatgcgtggacaaagctctgctggaaattcctgaggatgaacttgatcttcgacaaatacctattaaggatattattttacttgaagaacatagggagtggctggcggtgtgtatactctattctaatccttgtgtttcaatgtctaacaattgttag

SEQ ID NO: 4493 - DNA, 1357 bp, Glycine Max
tgcttgttagattgtgattgtgtggcttctgtttatggactaaatgaggagagaccctattgttgggtgttgaggagcttaagttttggtggttttgaggatacaagctcaactttgtttgtgaaggtcagagcaaatgggtcatggactttagaaggccaagaaggagggtctaatagctcctctgatggaatgggaagtgcaaaggagaaggctgtgattattcctactgttctgagtatggtagttctcattgttttgctgagtttattactgtactacactgttcatagaaaaagaactttgaaaagggagatggaaagttccttgatcttatctggtgctccaatgaatttcacataccgcgatttgcaaattaggacgtgcaacttttcacagctgctaggaacaggtggatttgggagtgtgtataaaggaagcctgggcgatggtacccttgtggcagtgaagaaacttgacagggttttgcctcatggagagaaggaatttatcactgaagtaaacactattggctcaatgcatcatatgaatttggttcgcctatgtggctattgttcagagggatcacacaggcttcttgtttatgagttcatgaaaaatggatccttggataaatggatcttcccttcatatcaagcgcgagatagattgctagattggacaactcgtttcaatatagccatagctactgcacaagggattgcatactttcatgagcagtgcagggatcggataatacattgtgacataaaaccggaaaatatattggtagacgaaaacttttgtcctaaagtatctgattttggactggccaaattgatgggaagggagcactctcatgtggtaacaatggtcagaggcacaagaggttatttggcaccagaatgggttagtaatcgccctataactgtaaaagctgatgtttacagctatggaatgcttcttttagagatcattggtggcaggagaaatcttgatatgtcctttggtgctgaggactttttctatcctggttgggcttacaaggagatgacaaatgggtcaataattaaggtggcagataaaagattaaatggggcagttgatgaagaagaggtaacgagagctctgaaagttgcattttggtgtatccaagatgaggtttctatgcgaccaacaatgggggaagtggtaagactgctggaagattcaatcgacattaatatgccaccaatgccacaaacagtactagagttaattgaggaaggcttagaccaagtatacaaagctatgaaaagagagtataatcaatctagctcattcactattaccagccatcttacatctcatgctacat

SEQ ID NO: 4494 - DNA, 180 bp, Glycine Max
tgtgttggaaagtgcaattacaggtgcagcaaggctgggaggaacgtaatgtgcctaagggcatgcaatgcttgctgccagaggtgcaactgcgtgccaccaggcacttctggtaaccgagatttgtgtccttgctatgctagactcaccacacatggaggacatctcaagtgcccatga

SEQ ID NO: 4495 - DNA, 1185 bp, Glycine Max
tgttgtggacaagaagaccttgataatgatatattagctcctatggagaaagcagagcaggaagctctatactccaccattcaaggctttgttggtgattcctggaatggctcagatctctatccagatccttgtggttggactccaattcagggggtctcttgtgatctgtttgatggattttggtatgttactgccttgaacattggaccggtccatgacaattctctgagttgtgctcaagaattggaatttagacgagagttatttgagctcaagcacctaaaagctctatccttcttcaattgctttcaatcacaagacatgtttccagctaccatccccactggaaactggcagaaactggctggcagcttagaatcactggagtttagatcaaacccgggtctcattggaaacatcccctcaagttttagtgccctcaagaaccttcaatcactagtaatactagaaaatagtgtaacaggtgaaataccatcaagcattggcaatctcatcaagttgaagaagcttgttcttgctggaaactatcttactgggagtattccagatgtttttgatgggctaaatgagttattgatctttgacttaagtagcaattcattgtctggctctttgcctttgacacttgggagcttaacttcagcattgaagcttgatgtgagctacaaccaccttgaagggaatcttctaaatgcatttgctaatcttaagtatctgacccttatggaccttaggaataataggttcactggtgggttgaccttatctttgcaagagatgtcctccttagaggaattagttttgtccaacaatccattgggtggagacatcagattcctaaagtgggaaaacctcaacaatttggccattttggaactatccaacatgggattgacaggggaaattcctgagtctttatcagaattaaagttgttaagatttttgggacttagtgacaacaatctcacagggaacctgtcaccaaagctggaaactctgccttgtctcaatgcactttaccttagtggaaacaatctcacaggagagattaacttctctaaggacttttttggaaaaatggggaggcgttttggtgcttggaacaacccaaacctttgctaccaaattggactaatgtcatcaagccatgttccatttggg

SEQ ID NO: 4496 - DNA, 1029 bp, Glycine Max
ttaccagaggaactcatctcggagatcctctttagggttccggtgagatcccttctgcaattcagatgcgtctgcaaatcatggaaaaccctaatctcccatccccaattcgccatgcaccgccttcgtacctcaatcgcccatccaaacattgcccaccaacaattgacctcttccaaactcgtatcatactctgtgcattcactgctgcaaaactcttcaatccctgaacaaggccattattactcctcgacgagtcacaagtaccgcattcttggttcctgcaatggcttattgtgtttgtctgatattaacttaacccatgtcgtattgtgcaacccttccatcagatcgcaatccaaaaaattccaaatcatggtttcgcctcggagttgtttcacttactattgctttggctatgatcacgtgaacgacaagtacaagttgctggttgttgtgggtagttttcaaaaatccgtcaccaaattatatacctttggtgcagattgttattgtagcaaggtgattcagaatttcccgtgtcatcccaccaggaagccagggaagtttgtgagtggcactcttaattggatcgcgaaaagagacctaaacaacgacgatcaacaaaggatgattctttccttcgatttggcgacggagacctatggcgaagtgttgctgcctgatggggaccatgacaagatttgtagtcctacattggatgtcttgcgtgactgtctttgtgtttgtttctctgactgtagaaaaggtcattggattgtgtggctcatgaaggagtatggggttccaaattcttggactaaattggtgaccatcccttacattaagcttgggatttgtagatggtctcacttgtttgtgccattgtgcatttcagaaaatggtgttcttctcctcaagactacatcttccaaattagttatttacaatttgaatgatggtaggatggactatcttaggattgtggatgaacttgggtttgatattcatgtttatcatgaaagtttg

SEQ ID NO: 4497 - DNA, 1743 bp, Glycine Max
ttggaacattgcatcacatcccctgttggaactgagaggaacccacttatagttggtgatgagatttttctttctagatcaatgacaggaaagagggaattccctaggcaggacacaatattggacaggctgtctgagagggcgaagcaactgattactaacctagtgaagatacaaaatgatggcactgttgaagttgatatagaaatgagtgcatatgttgctccagaattgttagagctccaatcttttgtcgagtcaacagtgagtggaagtcttagttcagaatcaaaaaaatctgttccacggttacaaattgtcatacttgtggttggaactagaggcgacgtacaaccttttctggccattgcaaggagacttcaggcatcacatgagaattgcattaaatcattgttatctttgtattgctttcttgcatatcttatggagtatggtcatcatgttaggctggcaactcatgataatttcaaaacatttgtgaagtcagctggtgtagatttctatcctctgggtggcgatcctcgtgtattggcaggatacatggcaaggaataaaggtttaatcccttctggaccagctgaaatatctgtccaacgaaagcagctgaaggccatcattgattcccttcttccagcatgcacagcacctgatatggaaactggtgttcctttcaaagctcaagctattattgccaatcctcctgcttatggacatgtacatgttgctgaggcccttggggtgcccctccatatcttcttcacaatgccatggacgccaacatatgagttcccccaccctttggcacgtgttcctcaaagtgccggttattggctgtcctatataatcgtggatttactaatatggtggggaatgcgaagaattatcaataacttcaggaaaacaacactgaagcttgctcctattgcatacttcagtatgtaccgtggatcaatatctcatttaccgactagctacatgtggagtcctcatgttgttcccaaaccaagtgactggggccctttagttgatgttgttggttattgtttcttgagccttgcatcaaagtatcaaccccaggaagattttgtccaatggattcaaaaaggaccacctcctttatattttgggtttgggagcatgcctcttgaagatcctaaaggaacaacagatgttatattggaggcactaaaagatacagaacaacggggaattattgaccggggttggggcaatctagggaacttggcagaactttctgacaatgttttccttctggaggaatgccctcatgattggctgtttcctcaatgttctgctgtggtgcatcatggtggagctggaaccacggctaccggattaaaagctgggtgtccaacaaccatagttccattctttggagatcagttcttttggggagatagaatatatgagaaagaattgggaccagccccaatcccaatatctcagctcaatgttgagaatttatcaaatgccataagattcatgctccagccagaggtgaaatctctagcaatggaaattgctaagttgattgagaatgaagatggtgttgccgctgcggttgatgcattccatcgacatctgcctgatgagctgccactgccaactcctattccagtggaggaggaccacttgaatcctttgcagtggttttttctccaacttggaaggttctgttgtgcaccttgtggtggtgtgtag

SEQ ID NO: 4498 - DNA, 96 bp, Glycine Max
tttaacggttttatgttgttgttcgtgtgggctgtgcatatgattcgtatgtgtctgcactgtgatagtctaaattttggaggaagacgaagatga

SEQ ID NO: 4499 - DNA, 1035 bp, Glycine Max
tttcttctcatctgcatctttctttctgtttacaatatcaaagtgtgtgaggcacaagccaagcctcccacagcgaaggggctatcatataacttctacgacaaaagctgtcctaagcttaaatctatcgttagatcagagctcaaaaaggtcttcaacaaggacattgctcaagctgctggcttgcttcgccttcacttccatgactgctttgttcagggttgtgatgggtcagtgttattggatggatcagcaagtgggccgggtgagaaagaagcaccaccaaacttgactttgagacctgaggcctttaagataatcgaaaaccttcgtggtcttttagagaagagctgtggaagagtggtctcctgctccgacatcactgccctcactgcacgagatgctgttttcctttcaggaggaccagactatgagattcctttgggaaggagagacgggctaacctttgccacaagacaagtgacattggacaaccttccaccaccttcaagcaacgcctcaaccatcctaagctccctcgccaccaaaaacctcgacccaaccgatgtcgtagccctctcaggtggccacaccataggcatcagccactgcggttccttcaccaacaggctctaccccacccaagaccccgtcatggacaagaccttcggcaacaacctcagacgcacgtgccccgccgccaacaccgacaacaccaccgttcttgacatccgatcccccaacaccttcgacaacaagtactacgttgacctcatgaaccgccagggcctcttcacctccgaccaagacctttacactaatacgaggactaagggcattgtcaccgactttgccgttaaccagagcctcttctttgacaagtttgtgttcgctatgctcaagatgggtcagcttaatgtgctcacggggaatcaaggggagattcgtgccaattgctccgttagaaatgccaataacaagtccctcttgacttctgtggtgcaagacgtggtcgaaactttgatagaaatgtaa

SEQ ID NO: 4500 - DNA, 156 bp, Glycine Max
tttgtaggatatgaagaatatgtgcaacgaataaaagaaagcgatagaaaaggaagaagaagcgcttcgcgatgcacgaaagagaagaattggaagcaaagtttcggcgttttgtcttttataaaaaaaatgttaaatcattataattttctatga

SEQ ID NO: 4501 - DNA, 582 bp, Glycine Max
ttttccctttcagctgctagagcaggcaacttttactatcccctggaatgggatccaaggttctctgaacaagtttcatgttcagcagcatgtcttgagatagtgagcaaggaagatagatctggttatatagattataagcttttgtatatctatacttgtaaaactagtcttccattaccccccttttcccaattgtggaggatgcagttctatgattgcaaagggtgtccgattcaatgcagagaaaaaacaagttcggagttactactccatataagtatggtctttaccatgaagactgcatgcagtaagcatgagatcatcatccagacagatccaaagaactgtgagtacgtgatcatcagtgacagtggtgctcaaagaaaaacagaggattttgatgttgaggatgcagaaacttttgaactaccagctgacgaagagagagaaaagcttgctgaaccagtgattgtatgtctccacgtcaaaagaaaagagttgctgcagaaaaaactgcttccagcttcagagggcattgatcaatgctggctccatcttcccaggattatttccaagaat

SEQ ID NO: 4502 - DNA, 240 bp, Glycine Max
tttttcttctattgtcaaatctacagtgtttttcttttctctctcacacgaaaccctctccctccctttccctcagatttctcacttccttttctcctttccatttctcaccttctccccctctcttcatctcttctctaccccttttttggttttccttactcttacgaatcaaaacccgcaactttggacgtcgttggagggctttcgtcgctacccaccataactgacgaggggtga
